United States Patent 11,446,398 (REGULATED BIOCIRCUIT SYSTEMS) - sequence listing, part 85

SEQ ID NO: 190530 - DNA, 2756 bp, Homo sapiens
  Payload ID: 17636
  Gene Name: tetratricopeptide repeat domain 26
  ENST ID: ENST00000476296
  CDS Start-End: 71-478
gtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaaggagaaatgaagtagaagacaaagaacctaagggaaataggaagaagagagagacacaatggctaaagaaggaagagttaaaatctctatcacatagatattgatttctctaacaacactaatatgaatctttacatgtcttttccactctcacaattttagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaacatcagtttttgttgttgttgttgttgttgttgttgttgttgtttttgagacggagtctcgctctgtcgcccaggc

SEQ ID NO: 190531 - DNA, 1193 bp, Homo sapiens
  Payload ID: 17636
  Gene Name: tetratricopeptide repeat domain 26
  ENST ID: ENST00000474035
  CDS Start-End: 81-896
agaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggtgaataacgatttcccgtcttgactgagttcagtcctactctgctttggtacatcacagcaattagaaagattaataaaaggagatgcgccagcaagtaatgctttactccaagggaacccctcctcactgtggaggagataagttttaaagtactaatctgtttccttaaggaaatccttgttgggagaacaggaatatatttaatatttggaaagaagcacaaggcagtgtagatccaggtgtctgtttttttgagaaagacaaaggaacgtatccctctgtggtttaaaataaatgggaaatatttttgcatctttg

SEQ ID NO: 190532 - DNA, 2876 bp, Homo sapiens
  Payload ID: 17637
  Gene Name: tetratricopeptide repeat domain 27
  Uniprot ID: Q6P3X3
  ENST ID: ENST00000317907
  CDS Start-End: 232-2763
ggaagccagaccagagagcgtgcgtgtttttcccagggtgccccgcgctgctgttatggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagagagtggatctttcctacaattgctactggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgcattatcctagtgaatgtaagacataaactgacagctattcagagcttgccatggtggactttgagatgtgtgaatattcatcagcatttgcttgaggaacgctcacctctgctttttactcttgccgaaaactgtattgatcaagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtgctttgggaaaaagaacacggttccaggaaaattatgtggcacaactgattctagatgtaagaagggaaggggatgtcctttcaaattgtgaattcactccagcacccactcctcaggaacatttaaccaagaatcttgagctcaatgatgacaccattctgaatgacataaagttagcagattgtgaacagttccagatgccggatctgtgtgctgaagagatcgctattattcttggaatctgcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattcagcgccaacttgcaagtttgctctttgagttgggatgtaccagttcagcccttcagatatttgaaaagctagaaatgtgggaagatgttgtcatttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagctcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatgtggccataaaatgcagtaaaaacaaatccagttcccaagaagctgtacaaatgctttcttctgttcgactcaatttacggggcttgttatctaaagcaaagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaa

SEQ ID NO: 190533 - DNA, 500 bp, Homo sapiens
  Payload ID: 17637
  Gene Name: tetratricopeptide repeat domain 27
  ENST ID: ENST00000454690
  CDS Start-End: 138-263
tagggccgcaggtgtatttacggtaactgtcgccactagatttcagcgcctttggactctcctgttttcactttcttttgttgactcccgtgtggccctcgtgggagcctgttttggctgcagcggtgtctggggtgatgtggaccccggagctggcaattctgaggggattccccactgaggctgagcggcagcaatggaaacaggagggggtcgtcggttcagcactaattttcaaaagaataacccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggctcttgcagaccaatttgaagataaaactacatctgtattggaacgcctgaagattttctattgctgtcaagtaccacctcactgggccattc

SEQ ID NO: 190534 - DNA, 509 bp, Homo sapiens
  Payload ID: 17637
  Gene Name: tetratricopeptide repeat domain 27
  ENST ID: ENST00000448773
  CDS Start-End: 165-509
cttactcaagctcgggttcttctcctaggcggaagccagaccagagagcgtgcgtgtttttcccagggtgccccgcgctgctgttatggccgcctccttgagagagtggatctttcctacaattgctactggaagggaactatgaagccatattcttaaattcaatgactcaaaatatttttaattcaacaacaaccgctgaagaaaagattgatagctacctggagaagcaggtagtaacattcctggattactcaacagatttggacacaacggaaagacaacagttgatatttctacttggtgtgagcagtttgcaactttttgttcagagcaactggacggggccccctgttgacttacaccctcaggactttttgtcatctgttttgttccagcaattcagtgaggttaaaggactggatgcatttgttctgagcctgctcactctagatggtgaatcaatctacagcctgacctcgaagcctatactactgttattagcacgc

SEQ ID NO: 190535 - DNA, 687 bp, Homo sapiens
  Payload ID: 17637
  Gene Name: tetratricopeptide repeat domain 27
  ENST ID: ENST00000428527
  CDS Start-End: 1-141
ctcggggtgtggttttctctcggttgtgcctatttggccttggaagactatcaaggttcagcaaaggcatttcagcgctgtgtgactctagaacccgatgtctgtgcatattccactgtcttgtttacagaaactttgtagtaagttttgaaaatgctaatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcattccagtgcctctcaaaggcatacaagtgtgacacccagtccaattgttgggagaaagatattacatcatttaaggaagttgttcaaagagccttaggacttgcacatg

SEQ ID NO: 190536 - DNA, 297 bp, Homo sapiens
  Payload ID: 17637
  Gene Name: tetratricopeptide repeat domain 27
  ENST ID: ENST00000438654
  CDS Start-End: 1-216
ccagtgcacacattaactgaagtggagcttctggcatttacatcatgtttgctttcacaaccaaagttctgggccattcagacatcagccttgatcctccggacaaaacttgagaaaggaagtactcgccgagtggaacgggcaatgaggcagacacaggtggcacatgatgttcacttatcctgtcactggggatgttatttgatcattcagtaagcttgtgtttgtgagatttctccccaagtaaagttactctactcttttcccattgtaattaataaacattttcaggaagtg

SEQ ID NO: 190537 - DNA, 660 bp, Homo sapiens
  Payload ID: 17637
  Gene Name: tetratricopeptide repeat domain 27
  ENST ID: ENST00000433416
  CDS Start-End: 1-302
tttgttatgaaagagccgggcagcacggaaaggcagaagaaatccttagacaagagctggagaaaaaagaaacgcctagtttatactgcttgcttggagatgtcctcggagaccattcttgctatgacaaggcctgggagttgtcccggtaccgcagtgctcgtgctcagcgctccaaagccctccttcatcttcggaacaaggagtttcaagagtgtgtagagtgcttcgaacgctcggttaagattaatcccatgcagggaagcgggaggcctgaggagagggagaagataggagagtagctggtcagtggagcagtcagaacatacacagcatttatcactcggggtgtggttttctctcggttgtgcctatttggccttggaagactatcaaggttcagcaaaggcatttcagcgctgtgtgactctagaacccgataatgctgaagcttggaacaatttgtcaacttcctatatccgattaaaacaaaaagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcag

SEQ ID NO: 190538 - DNA, 11795 bp, Homo sapiens
  Payload ID: 17638
  Gene Name: tetratricopeptide repeat domain 28
  Uniprot ID: Q96AY4
  ENST ID: ENST00000397906
  CDS Start-End: 143-7588
gggggcgcgcgcgcggtttgggggcagtgaggggcgccgcggcggcgcgcagcacggcgggaacatggcgcgcggaaccggcgcgcgcgcctagctggcgggaccgttagctcgaggcggacgcggcccgggccccgtggggatggagcagtcgccgccgccggcgcccgagccgacccaagggccgacccccgcaaggagccgaaggcggcgggagccagagtcgccgccggcgtcggcgccgattcctctctttggtgctgacactattggccagagaagtcctgatggaccggtactgagcaaagctgaatttgttgagaaagttcgtcagagtaatcaggcctgtcatgatggagatttccacacagctattgttctgtataatgaagccctggctgttgaccctcagaactgcatcttatacagcaatagatctgcagcctacatgaaaatccagcagtatgacaaggcactggatgatgcaatcaaagctcgacttctcaatcccaagtggccaaaggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaa

SEQ ID NO: 190539 - DNA, 499 bp, Homo sapiens
  Payload ID: 17638
  Gene Name: tetratricopeptide repeat domain 28
  ENST ID: ENST00000442232
  CDS Start-End: 1-327
gagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacagggatgcaaccaggtttgcggaggcctgggattgggcctggacacatgttcttgctctgccaacttctcagccagtgaaggcaggtgacacttacctccaccaggtgatgcaggctgtggtgataaactagagtgtgaagagctcagagtgcagcctctggccttgccactcacaagctgtaggacactagggaggcagtttcacctctgtcagcctcagtctcgtcatctgtgaaatggggatggcttcttaccctgcagggttcctgtaatgtgggaataaaggagccaatgtataaataa

SEQ ID NO: 190540 - DNA, 905 bp, Homo sapiens
  Payload ID: 17638
  Gene Name: tetratricopeptide repeat domain 28
  ENST ID: ENST00000431039
  CDS Start-End: 1-905
gacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccggctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggacca

SEQ ID NO: 190541 - DNA, 11274 bp, Homo sapiens
  Payload ID: 17638
  Gene Name: tetratricopeptide repeat domain 28
  ENST ID: ENST00000612946
  CDS Start-End: 3-7067
aggcatacttccgacagggtgttgccctccagtaccttggacgtcatgccgatgccctggcagcctttgcatctggactggctcaagaccccaagagtctccagcttctggtggggatggtggaagccgccatgaaatctcccatgagagactccctcgagcccacttatcagcagcttcagaaaatgaaactggacaagagtccctttgtggtcgtgtctgtggttgggcaggaactcctgacagctggccatcatggggcctctgtggttgtcttagaagccgcactgaagattggcacctgcagcctcaaactgagaggttctgttttctctgccctgagcagtgcttactggtctcttggaaatacagagaagagcaccggatatatgcagcaggacttggatgtagccaagaccttaggtgaccagacaggagaatgccgagctcatgggaatctgggctctgcattcttctccaaaggaaattaccgggaggctctcactaaccacaggcatcagttggtactcgccatgaaactcaaagatcgagaggcagcttcatcagccttgagcagtctgggccacgtgtacacagccattggagactaccccaatgcactggccagtcacaaacagtgtgttcttcttgccaagcaatccaaagatgaactttctgaagcccgagaacttggcaacatgggagctgtgtatattgccatgggtgactttgagaatgctgtgcagtgccatgagcagcatctgaagatagccaaggacctggggaacaagcgagaagaggcccgggcttatagcaacctgggcagtgcctatcactaccggaggaactttgacaaggccatgtcttaccataactatgtcctggagctggcacaggagttgatggagaaggctattgagatgcgggcctatgctggactaggccatgctgccaggtgcatgcaggatttggagagagctaaacaataccatgagcagcagctgggcattgctgaggatctcaaggaccgggctgcagaggggcgagcatcctccaatctaggaatcatacaccagatgaaaggtgattatgacactgcactgaaactccacaagacccacctgtgcattgcccaggagctgagtgattatgctgcccagggccgtgcctatgggaatatgggcaatgcctacaatgccctgggcatgtacgaccaggcggtcaaataccatcggcaggagctgcagatctccatggaagtgaatgaccgcgcctcacaggcctccacacatgggaaccttgccgtggcctaccaggccctgggtgcccatgaccgggccctgcaacactatcagaaccacttgaacatcgcccgggagctacgagacatccagagcgaggcccgggccctcagcaacctgggcaatttccactgctctcggggagagtatgtccaggctgccccctattatgaacagtacctccggcttgctcccgaccttcaagacatggaaggagaagggaaggtctgccacaatcttggctatgcccattactgccttggaaactatcaggaggcagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcacacacaggaactggaggtatatcaggagctgagtgacttgccaggggagtgcagagctcatgggcacctggctgctgtctacatggcccttgggaaatacacaatggcattcaagtgttatgaagagcaactggatctagggcaaaagctgaaggatccgagtctggaagcccaggtctatggcaacatgggcatcacaaagatgaacatgaatgtgatggaagaagccattggctactttgagcagcaattggccatgctgcagcagctaagtggaaatgagtctgtgctcgacaggggccgggcctatggcaacctgggggattgctacgaagccctgggtgactatgaggaagctatcaaatactatgaacaatatttatctgtcgcgcagagtctgaatcgcatgcaagaccaagccaaggcttaccggggcctgggaaatggacacagggcaatggggagcttgcagcaagcccttgtgtgctttgaaaagaggctcgtggttgctcatgaacttggagaggccttcaataaagcccaggcctatggagagctgggaagtctgcacagccaattagggaattacgaacaagccatttcctgccttgaacgccagctgaacattgctagagatatgaaagaccgagccctggagagtgacgcagcctgtggcctggggggcgtttaccagcagatgggggagtatgacacagccctgcagtaccaccagcttgatctacagatagcagaggaaaccaacaaccccacgtgccagggccgagcctatgggaacctgggcctgacttatgaatccctgggcaccttcgagagggctgtggtctatcaagaacagcacttgagcattgctgcacagatgaatgacttggcggccaagacggtgtcatatagtagccttggaaggacccatcatgccttgcagaactattcccaagcagtcatgtacttacaggaaggtttaaggttagctgagcaactgggccgaagagaagatgaggcaaaaattcgccatggccttggcctctccctttgggctagtggaaacttggaggaggcccaacaccagctttatagggcatcagccttgtttgaaacaatccgacatgaggcacagctgagcacggactacaaactctccctctttgacctgcagacatcatcctaccaggccttgcagcgggtgctcgtcagcctaggccatcatgatgaagccctggctgtggcagaaaggggacggacaagggcatttgctgatcttctggtggaacgacaaacaggacaacaagactccgacccctactccccagtcactattgatcagatcttagagatggtaaatggccagaggggactagtgctttactattccctggctgcaggctatctgtatagctggctgctggctcctggggcaggaattgtgaagtttcatgaacactacctgggtgagaacacagtggaaaactcaagtgacttccaggccagcagcagtgtaacccttccaacagcaaccggctcagccctggagcagcacattgccagtgtccgggaggccctgggggtggagtctcactactcaagggcctgtgccagcagtgagacagagagtgaagcgggagacatcatggaccagcaatttgaagagatgaacaacaaactcaactcggtcactgaccccactggctttctgcggatggttcgccgcaataacctgtttaacaggagctgccagagcatgacgagcctgttcagtaacactgtgtcaccgacccaggacgggacctcctctcttcccaggaggcagagctcgtttgccaagcccccgctccgtgccctgtatgacctgctcatcgcgcccatggaagggggcctgatgcactccagcggccccgtgggccggcaccggcagctcatcctggttctggagggggagctctacctcattcctttcgccctcctgaagggaagctcctccaatgagtacctctacgagcgcttcggcctccttgctgtcccttccatccgctccctcagcgtgcagtccaagtctcacttacggaagaacccgcccacatactccagctccacatccatggcggctgtcatcggcaaccccaagctaccatcggccgtgatggacaggtggctgtgggggcccatgccatcggccgaggaagaggcctacatggtgtccgagctgctgggctgccagcccctagtgggcagtgtggccaccaaggagagggtcatgagtgccctgacccaggctgaatgcgtccactttgccacccacatctcctggaagctgtcggccttggtcctcacgcccagcatggacggcaaccctgccagcagcaagagctccttcggccacccctacacgatccctgagtccttgcgggtgcaggacgatgccagtgatggggagagcatctcggactgcccgcccctgcaggagctgctgcttactgccgccgacgtcctggacctgcagctgcctgtgaagctggtggtgcttggctcctcccaggagtccaacagcaaagtcacagccgacggggtcatcgcgctgacaagggccttcctggctgccggcgctcagtgtgtcctcgtgtctctgtggcctgtgccagtggctgcttctaagatgttcatccatgccttctactcatccctgctgaacggcctgaaagccagcgccgccctgggggaggccatgaaggtggtgcagagcagcaaggccttctcgcacccctccaactgggcagggttcatgctcatcgggagtgacgttaagctgaacagcccctcatcactcatcggccaggccctcacagagatcctgcagcacccggagcgtgcgcgggacgccctgcgagtgctgctgcacctggtggagaaatccctgcagcgcatccagaatgggcagcgcaatgccatgtacacatcccagcagagtgtggagaacaaagtgggcggcatccctggctggcaggccctcctcaccgctgtgggcttccggctggaccccccaaccagtggcctgccagcggctgtcttcttcccaacctccgacccgggcgaccggctccagcagtgcagcagcacactccagtccctgctgggtctgcccaatcctgccctccaagccctttgcaaactcatcactgcctccgagacgggcgagcagctcatcagccgggctgttaaaaatatggttggaatgctccaccaggtgctggttcagctccaggctggcgagaaggagcaggacttggcatcagctcccattcaggtctccatcagcgtccagctgtggcggctcccgggatgccacgagttcctggcagctctaggttttgatctctgtgaagttggtcaggaggaagtaatcctgaaaaccgggaagcaagctaatcgacggactgtgcacttcgcgctccagtccctgctgtctctgtttgattctactgagctacccaagcgcctcagccttgacagctcctcctccctcgagtctcttgcttctgctcagtctgtttccaacgccctgcccttgggttaccagcaaccccccttctctcccaccggtgcggacagcatcgcctcagatgccatctctgtgtacagtctgagctccattgcctcctcaatgagctttgtctccaaacccgagggtggatcagagggtggaggccccggaggacggcaggaccatgaccggtccaagaacgcttacctgcagagatccaccctgcctaggagccagctgcctccccagacccgccctgcaggcaacaaagatgaagaagaatatgaagggttttctatcatcagtaacgagcccttggcgacctaccaagaaaaccgaaacacatgcttctcaccagaccacaaacaaccccaacctgggacagccggaggcatgagagtctcggtgagctccaaagggagcatcagcactccaaattctccagtgaaaatgactctgattcccagccccaactcacccttccaaaaggtgggaaaactagcaagctcagatacaggagaatcagaccagtctagcacagaaacggacagtaccgtgaaatcccaagaagaaagcaacccaaaactggatccacaagagttagcccagaaaattctggaggagacacagagtcatctcattgcggtggagcgtcttcagaggagcggcggccaggtgagcaagagtaataaccctgaagacggcgttcaggcgcccagcagcactgctgtcttcagagcgtcagaaaccagtgcgttcagcaggcctgttctctcccatcagaagagtcagccatcaccagtcactgttaaaccaaagcccccagccaggagctcctccctgcccaaggtgagttccggatatagcagccccaccacctcagagatgtccatcaaagacagcccgagccagcacagtggccggccatcgcccggctgcgactcacagacttcccagctggaccagcctctctttaaactgaagtaccccagctctccttacagcgctcacatttccaaatcaccaaggaacatgtccccaagctccggccaccagtctcctgctggcagtgcaccctccccagctctctcctactcctcagctggatctgctcgctcaagtccagcagacgctcccgacatagacaaactgaaaatggcagccattgatgaaaaggtgcaggctgtccataacctgaagatgttctggcagagcacaccccagcattccacagggccaatgaagatcttccggggggctcctggcacgatgacttccaaaagggatgtcctcagtctgttgaatttgtcaccacggcacaataagaaggaggagggagtggataagcttgaactgaaggagctgtccctgcagcagcatgacggagctccaccgaaagcccctcccaacggacactggcgcaccgagaccacctcgctgggctcactgccgctgcccgccggccctcccgccacagcccccgcgcgccctttgaggcttccttctggaaatggctacaagttcctgtctccaggaagatttttcccttcttccaaatgctaaagcatcttttatacccactgactctgagcagcctgcagatgggggcctggcgtttgcttcagcccttccctgagtgcagtccccccacagccaccagcaccctcatgatgctgtgctctgcaggcgaggggcaccaccacgtccaaaggctgccacacacactggtggcttttctgggccacattcaccaaaagccaggacttctgtggggctggtacaggaggctcatggaatttcctacacacttcaccaaatgtttgtttacctttgaactccctgcttctcatctttgatatgattcttcaccaggattttgtacaaaaatgatcatggttctggggtggggagaggaaagggagcacatattttgctaagaggtatatatgcagtaccttttatacacagaaatacaaatagagctttttctaaggctttcggttgctggttgggggtgggatatatgaaatttcagttgaattctacaggaaagtgttatattagccaaaaacagaaaaatggtttttaaaatgccaatgatttgtaattaaattgtagcaattttggtctcatgatagtgtaatatctcagcaacaatgcaataattcacattgaaacagcgcttccattctgaactctgctctgcaaatgtcttttgggtcccgctgtcaaccaaacttgaattttcttaaaaaaaaaattatgtaactcttatccaggcattttagaactatgcaattgtgatttaaaatgcaactttgtgcttttaaaacattattgaccttttttgtatatggataaacaacttggttttattatcaatagtactttgcatttatagctattatttttaaaagctcaaaaagttttttaaaatgtcaaattttgaatagtcatcaataagtaattatcaagtttggaaggaaaggttgaaatgactccgtttccttataagcaaaaaaaaaaaaaaaaaaaaaaaaaaaaaaaaaaaaatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttaggtaattctaaaattaaaatcctacccacctcactacagggttcctcatgaaggtgggcggccacctggcctgggccaccagcagcacatggagcagacctgaggggcctggcagggggcactgacctcaggatccccaggtgggggttttaaccatgggtgggatctcagcttctgcgcatacactgacaatctcacctgttcctcagtgtactcctctgaaaagaagaaaggataatatttatccaatctgtgttctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggcctttttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaa

SEQ ID NO: 190542 - DNA, 1785 bp, Homo sapiens
  Payload ID: 17639
  Gene Name: tetratricopeptide repeat domain 29
  Uniprot ID: Q8NA56
  ENST ID: ENST00000325106
  CDS Start-End: 228-1655
ctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 190543 - DNA, 1729 bp, Homo sapiens
  Payload ID: 17639
  Gene Name: tetratricopeptide repeat domain 29
  ENST ID: ENST00000398886
  CDS Start-End: 174-1133
aggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattg

SEQ ID NO: 190544 - DNA, 1886 bp, Homo sapiens
  Payload ID: 17639
  Gene Name: tetratricopeptide repeat domain 29
  ENST ID: ENST00000508306
  CDS Start-End: 179-1270
gagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagagacatgagtctgtcttcaaataattctcacctcttagccttgcttcttatctggaatattttagcctccttcccaggatttgaattcctggtcgattcagtcaaggctaagtgaagagttgaacaattatctggtgaattttggcactaccagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttca

SEQ ID NO: 190545 - DNA, 2226 bp, Homo sapiens
  Payload ID: 17639
  Gene Name: tetratricopeptide repeat domain 29
  ENST ID: ENST00000513335
  CDS Start-End: 201-1706
agccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaatggctacactggtgtgggttaagaacttagatgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattggattttgcatttcagtgtgttactataaatttaatccaaaacatctaaatccatgaaaataaaatatattccaattcttagaaatatcagcaatcatccatgaaataaatgatttcctcttatccactattccacaagaaatagtgataccatgaaaccaaaataagaaaatattttctaatgagaaaataattacaagcttaagaaaatctttcatgctgaattcatgtaggaaaatatttgctaaaactctagggaaacttctcaacatagataaaaggagtataagcaattaagcctaccatactgataagtcttgtttgaaacagttttctttacctgtgtaacagtatattttatgatacttttagctgatagcacataataaaac

SEQ ID NO: 190546 - DNA, 565 bp, Homo sapiens
  Payload ID: 17639
  Gene Name: tetratricopeptide repeat domain 29
  ENST ID: ENST00000515315
  CDS Start-End: 285-565
cagcagtaatctgcaaatagattgtagctgtgatacaagagccaaccagcagatcaaagagtacaccaaatttcttctgaataccaacagtggaatggcttcaggcggccttttgatctttgtctcagcacccgatgatgccacactgtagcactgcccacttgctagcactggcggaggttcctgtgggtcctcctaacaggctgattcagcctgagctcctggggctaagctcatttggtagcagccaaagagggctacactggtgtgggttaagaacttagatgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatat

SEQ ID NO: 190547 - DNA, 557 bp, Homo sapiens
  Payload ID: 17639
  Gene Name: tetratricopeptide repeat domain 29
  ENST ID: ENST00000502319
  CDS Start-End: 479-557
tgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaatgtgggggccaaacttagagattgtagctgtgatacaagagccaaccagcagatcaaagagtacaccaaatttcttctgaataccaacagtggaatggcttcaggcggccttttgatctttgtctcagcacccgatgatgccacactgtagcactgcccacttgctagcactggcggaggttcctgtgggtcctcctaacaggctgattcagcctgagctcctggggctaagctcatttggtagcagccaaagagtccgaaatgaccaccctgcccccactgcccatgacacgcccgaagcttacagccttagccagacagaagctgccttgctcctcca

SEQ ID NO: 190548 - DNA, 1777 bp, Homo sapiens
  Payload ID: 17639
  Gene Name: tetratricopeptide repeat domain 29
  ENST ID: ENST00000504425
  CDS Start-End: 228-1652
ctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttc

SEQ ID NO: 190549 - DNA, 9084 bp, Homo sapiens
  Payload ID: 17640
  Gene Name: tetratricopeptide repeat domain 3
  Uniprot ID: P53804
  ENST ID: ENST00000354749
  CDS Start-End: 1469-7546
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaacccttagtctgaaactttaccaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttca

SEQ ID NO: 190550 - DNA, 7712 bp, Homo sapiens
  Payload ID: 17640
  Gene Name: tetratricopeptide repeat domain 3
  Uniprot ID: P53804
  ENST ID: ENST00000355666
  CDS Start-End: 106-6183
gtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatg

SEQ ID NO: 190551 - DNA, 2115 bp, Homo sapiens
  Payload ID: 17640
  Gene Name: tetratricopeptide repeat domain 3
  ENST ID: ENST00000399010
  CDS Start-End: 87-989
cggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaacacattctcatggtagaaaatttggaaaatacaagagtttaaaaagaagaaaataaaaatcaccagtaatccaaccaccttggagaataccgctgtattaacgttatgcagcttttagatggcttaagccgtggataaaccgaggctatctagactagaggaatggatgggcttgacacagtcttccatcaataccactgtcctcaacgggttctgacaagaaatgagctgcacatgtctttaggttattgctactggctaggtccagaattgcatttattttgtgctgtttgaaggtgaatttgtatgctttcaagatcagatgaataggttggcaacttggctagcctcttgtgaaaattgaggtgcctgtctgaaatattgcctggcagaaggttttccactttccacttctgagagctgagaggcacaccagggtgtttctgctctctttcatgagtgttgaatgctagacacacaaggaagatccttctaataccttgctgcaacaggaggtgaatcagagtagaagtacagaagctaggtagtttggtgaggtaaaggccaagagcagcttgtggatctatccttgtacctccttgctgatggtctagcttgtggtttaataccatctacatttcactaaagccaggtcagcagcattgttcctttgtttcttattaggcaatcaccaatatatattggatgcctattttattcacgaagtgttttaccacactggttttgctggtgtttcctacctcctcacacattgtctatatgatttgctcagtaatgtagggataatgttttcagagtccatagtatatataactcctgatcaggtgactagatggtgtgacttaaggaaagaacacgttgccagtaattcagatgtgccattgacacaggaggacccatgcctgagaaagacttttatctgagttactgagattaagatgttttgaagctcccaagcagagggatgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaat

SEQ ID NO: 190552 - DNA, 10363 bp, Homo sapiens
  Payload ID: 17640
  Gene Name: tetratricopeptide repeat domain 3
  Uniprot ID: P53804
  ENST ID: ENST00000399017
  CDS Start-End: 2748-8825
tgtattctttaaatattatgtctcattagtctcttctctcctgctggaactttaactggatatatatatacactaaactgtttccagatcacttattctttatctttcatattttttatctctttgtttctctttaccagaatttacagtgctggataatttcataaggcatatattttagttcaccaattttctcttcaactgtgcctaatatcctctgtaacccatcctgtctcttttttttcttttaacaattgcatttttaattactttttttttttttttttaagatggagtctctctctgtcgcccaggctggagtgcagaggcgcgatctcagctcactgcaagctccgcctcccgggttcacgccattctcctgcctcagcctcccgagtagctgggactacaggcgcccgccaccacgcccggctaatttttttgtatttttagtagagacggggtttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggcaccactacttgtagcactaaactgtagccaggtttaatttctagctcaaggtttgttgcttttgcgtggagagggtgccttcacatgttcccctatttctatgagctcagcaaaaacatccaaaaagtgtttttttttttaatctaggatatacctttttcctcccaacagtacattcccccagagtgtatagttgaccataactgatgggatcagaagctctttattttaatatttaattttagtagtatatttttgtttgattgtattataaaaaattttatggtaccaagcaagctttcttggtgataccaacatttccattaaaactagtttacatctaagttaagatttgagttatcctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttca

SEQ ID NO: 190553 - DNA, 893 bp, Homo sapiens
  Payload ID: 17640
  Gene Name: tetratricopeptide repeat domain 3
  ENST ID: ENST00000411496
  CDS Start-End: 1-893
gaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggatattttcacagcatcatgggaaagattgcatgttacactgacagaatctattaacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaact

SEQ ID NO: 190554 - DNA, 3606 bp, Homo sapiens
  Payload ID: 17640
  Gene Name: tetratricopeptide repeat domain 3
  ENST ID: ENST00000438055
  CDS Start-End: 110-3606
cgccgtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaa

SEQ ID NO: 190555 - DNA, 999 bp, Homo sapiens
  Payload ID: 17640
  Gene Name: tetratricopeptide repeat domain 3
  ENST ID: ENST00000428693
  CDS Start-End: 1-952
tgatcctgcagcatatcctgacatggagtctgatatacgttcatgggaattgtttctttctaatgttacaaaagaaattgagaaagcaaaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaa

SEQ ID NO: 190556 - DNA, 3771 bp, Homo sapiens
  Payload ID: 17640
  Gene Name: tetratricopeptide repeat domain 3
  ENST ID: ENST00000418766
  CDS Start-End: 235-3771
gccacccgctccctcccgccgtcggctgacgtggagggccggaggtggcggcggcggcggcggcggctgctgctgctgctgcccgcgtccgaggctcgcgggcggcgggcccgggtgagtgcacacccggcgcgctgccgggctcccggatgtgtcaccttgtcccgctgcagccgagatgccgggggagcggggccttccacaccccctccgtgggtgtgtgacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaag

SEQ ID NO: 190557 - DNA, 2451 bp, Homo sapiens
  Payload ID: 17640
  Gene Name: tetratricopeptide repeat domain 3
  ENST ID: ENST00000450533
  CDS Start-End: 110-2451
cgccgtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaa

SEQ ID NO: 190558 - DNA, 831 bp, Homo sapiens
  Payload ID: 17640
  Gene Name: tetratricopeptide repeat domain 3
  ENST ID: ENST00000414818
  CDS Start-End: 1-831
gaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttg

SEQ ID NO: 190559 - DNA, 2025 bp, Homo sapiens
  Payload ID: 17640
  Gene Name: tetratricopeptide repeat domain 3
  ENST ID: ENST00000540756
  CDS Start-End: 170-2008
gtggagggccggaggtggcggcggcggcggcggcggctgctgctgctgctgcccgcgtccgaggctcgcgggcggcgggcccggaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacgaagggg

SEQ ID NO: 190560 - DNA, 5975 bp, Homo sapiens
  Payload ID: 17641
  Gene Name: tetratricopeptide repeat domain 30A
  Uniprot ID: Q86WT1
  ENST ID: ENST00000355689
  CDS Start-End: 266-2263
gcggcgccacaggaacgatgcatgccgggaccgggaagattcagtctctgaacggcccggagtagtcgtctttccccttctgactgccgccacgctgcagtccagaatatttgaagatcaaaccgaacttgagagactaacgagaacggtccctttttattcctaacagattccttccgtggcaaagtaacccgtcgtcttccgtttccggttgcccggttgccctgttgccgtggtaaccgcacgcataacagccgtggtggttatggctggtctgagcggcgcgcagatccccgacggggagtttaccgcgctagtgtaccggctcatccgcgatgcccgctacgccgaggcggtgcagctgctgggccgagaactgcagcggagccccaggagccgtgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaaactatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagagatgatgaagctatcaaaaaggcagtgaatgaatatgatgaaaccatggagaaatacattcctgtgttgatggctcaggcaaaaatctactggaatcttgaaaattatccaatggtggaaaaggtcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaatcggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagtttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctcagcatagactatgctgtctgataaatctaattcttaactctatttctccagttttttagtcctttaactttctggattgcaacgaagtctagtttagacctctaagcccttttagaagtacaagtataatgggaatttcttttcttggttcttttcaggttatgaggtttggtcagtgacaaaattttttttcataatttggttgattggttgcttcttaagttttataataaacgtttttcttcatgttctatttttgattttacagaaatgattttgcctccttgtggatactgacatatattaagtgtggaagcttattaatatttttggttttttaaaaactgaaatttttaatttttactttttaattttttaggaaaaaataagcactgaactgagaatgagaagaataaaagtatgagttccataccttctaattttaggctgtcagaaattcctttattctttgggatttcacaatcatttgaactatcagaagcctttacaattacttttagctgtaacatccgattctgtataagccacatagaaaaaagttgcctttctttttttatgacctggatatataagcaaatcagctaggaaatatataattgtattttatattaatgttttctaggattttggcttacagtaaatgttaacccctatggtaagtgattgttattgttggatgttatactgattattaataagaaatttggatttttgcctttttacctggaatttttgcttacagccgtagctatgaatatatatagggtggtccccagtctctgttatggttgcgcataaattaataattttataagtatttagaaatggtataattctcttaacttcctctttcagtttttgtactaatgtttgtttttgttcgggaagaggagatttgcttttaatccttccaaaaaatgatgaaccaccgttccattcagtagtttgacaagctgttataatgtgtattttttcctcaattattcttgaaatatttagagcctctcctgcttctaacatgaaggcctttagatgccagtctgccagaaatctggaaacagaggaaccggtgaagtgaagatgtaatggagatttagctaatgatgtacttcacaatccaccttggatctcctgcatgtccaaatctcagtagttaatcaagtgtctgctgccattaacagaacagaagtaatggataacagaatggaaataagagatgccagaactacttccataactaactcaccaaatcaaatcatcagtcctcatattcttgttttatttaatacaaggagaagaggccatgcactttccaaaaggtcaaagccacatagaataggaaggcaatctctagtttaaagctttctcttggagtgttttctccccctgtcttcaaagggtctacttgagagatagtggtgtttactgctgcagcatgtatcacaagataagaaatgaaaaatcaatctttcttaccaccctgttctctttcccttttttatcttttcccttttgtcaattatagaattatagggacatttttctctgatagctggaagttgaacctcaaccaggtataaaagatgcataacaaccttttagcagtaagtgtcaagtgagtgagcactatgattatcaaggtgactttggaaaccttttaaaaatgcatttttgcaaaacaagataacatatattgataaaaagtgactctcagattggtaatgccagaaaaaattttaagaggactcaccaaaagtactagatctatgtaagttgtagaatagagtgaagtttttttatatatttgtggtagcctccatcttttaaactttttgaactcagtagaaaaacagactgaaattttaaagacatgcagtatttgtatcattttaaattctgtaacactgggaattaaatatactcaactttagaggacacttgccttactgtaatctataatcattttatattgaaaaatagggccagacattagccaaacggtaattaatttactagccataggtatagtgtttaatattctcttggggagtgagtctttactaagtgattactctatacttgataccactattaattgaggttcttttggttgtttaattaaatcagctcctttggatttgggccaagattgatccaccacatactgaaatccgttctacaacatcataatgtgtatttactagaaaaggacttgcttcataaggaaaaattattagaatatagagacttataagtacatttctagtgtgaaaaataagcatttgttagtttaagtgagacctgccaataacttgattgcaaatattaatatcatgtgaacatataaaatgggcccaaatccttgttcaaaagtgaaatttgcacgtttgtgaaataaaacacatcaatatcaatgactgaataccttaattcaaaacagcaaatggctaaaattatactatgcaagcaggaccctagtaagttatgtgggaaagcatttattgctgctaatattttattttcaattatttcattaggagagtcaaatgcttaagatagaggacacatgactaaaagtttcaccagcactcatggcatctgctataaaacatgtgtccacagagtacccacaaactctcaagatcttaagtctcaacagtaaattactggttagtttttctaatcagagtctcaacgtcttagtcccaattcttccaaattttccaaaaccatacactatagtgtatatggaaaggagaatatgtacttttgtgaatataaagtgtctgttccatttttagtcatgaagtaccataggaagagatggtcacaccctaacattgtaaagcaaaagaaagcttcaggaatcagaccataacagcaacactttgctgaaaaatatttaattagaaggcaataccacatactcacatatgctaaggagtgcaattattttgtatgtttactggaaaaggcaaaaaatttttctgtagttaaaacaatatttttgtttctagaacttttgttcttgtactgattcattaccattaaactgttttcacaaaatgccaaagaacagaggagagctatacatgatttgaccaagacgctgcaagtagtttcagaaactgaggagactatttttctgacaatgtatataagatctataatgaaatgattggtaaaattataaaatggttctggaaataatcatgtaaaatataaaatgggaaattgtaaa

SEQ ID NO: 190561 - DNA, 4017 bp, Homo sapiens
  Payload ID: 17642
  Gene Name: tetratricopeptide repeat domain 30B
  Uniprot ID: Q8N4P2
  ENST ID: ENST00000408939
  CDS Start-End: 252-2249
gcggaaccactggaacggtgcatgccgggacgagtagattcagtctctgaacggcccggagtagtctttcccctcctgaatgccgccactccgcagtccagagtatttgaagatcaagctgaaattgagagactgacgagagtggtccctttttgttcctaacagatttcttgcgacaaggaaaccggcagtcttccgcttccggttgctctgttgccatagtaaccgcacccataacagccgtggtggttatggctggcctgagcggcgcgcagatccccgacggggagttcaccgcggtcgtgtaccgcctcatccgcaatgcacgctacgccgaggcggtgcagctgctgggcggagaactgcagcggagccctaggagccgcgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatgcggaggccacccgggtcgccttccttctcctggataaccccgcctaccacagccgggtcctccgcctgcaagctgctatcaagtacagcgagggcgatctgccagggtccaggagcctggtagagcagctgccgagtagggaagggggagaggaaagtgggggcgagaatgagaccgatggccagatcaacctgggttgtttgctctacaaggagggacagtatgaagctgcatgctccaagttttttgccgccctgcaggcctcgggctaccagcctgacctttcctacaacctggctttggcctattacagcagccgacagtatgcttcagcactgaagcatatcgctgagattattgagcgtggcatccgccagcaccctgagctaggtgtgggcatgaccactgagggcattgatgttcgcagtgttggcaacaccttagtcctccatcagactgctctggtggaagccttcaaccttaaggcagctatagaataccaactgagaaactatgaggcagctcaagaagccctcactgacatgccacccagggcagaggaagagttggaccctgtgaccctacacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgatttataagttcctcacaccctatctctatgacttcttggacgctgtgatcacttgccagacagctcctgaagaggctttcattaagcttgatgggctagcagggatgctgactgaggtcctccggaaacttaccatacaagtacaggaagcaagacacaatagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccagataagaaaatgtaccatctctgcattgtgaatttggtgataggaactctttattgtgccaaaggaaattatgactttggtatttctcgagttatcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttcctttcctctgttatcttttgtgctttgacgtatcttgaggggtctttgcacaaggattacatcattcagggaccaagcactatctcagtaatagttaagagtagtctttaaataatcatttcagggattgtgtgagagtagtctcacaatttacactcattaatttgtaatgcatactttttatatagactttaggatattttggcagtgtttattcatatggatataattctttacctaaccaaaattccttaggttataagtggttttaacgtgcaaaagtcagtaaaaaattttgttgccttaacaaaattatggtgctataatgtagagacaatgaacgattatcaaagaacaaatttccctggttttcttttgttccctttaataatttaaatatatgaacaagatacactgttactattttccatgataactttttaaatatctctgtgagaaataacagagctatcctgagaactcaggggtttgtttaagagacacaggttttgttatgtttgttgcccaggctagtatccagctcctaggcttaagcatactcccacttcagcttcccaagtagctgggactactggcacaaatcactgggtccagttctcagttcttaattcctacctttgtgtttgcaatttaggatatgctggctgtacagtgtttccatgttgtagcctcttgaataaggaaaaatctcagccaccaggtctgaccaaaaaggtcaattctaagttgtaatgttcatttcatgtccgcaactcccaagagttatttggagttcccactgggaaccacatgcattctgatcaggcattttattttctgaaccttacaagagccttactatttgatttcccactcctcactcctctcttcccacaaaaagtaactgtcaatcctaacttgacctggcttagaaaaatcaagtgtattagactgaatcatatgcagttgttgattttgacagtttttgatgtacaaaactagcagtttctcatagctcaacctagtagctttcttctgaatgatagggaacctctgccataatgagatgattttttccttcaaggaaaaggaaccacttagccacataagtactgataagaaacatgctcagcataattcctctgtagcatgacctcctgagtgctcaaattgtattataccaggaaatttggcttattgtgaagttcaatggttttgaatttatggcattttaaatcttaattatctgagctgctatcatttaccactgatgctttagtctcacatgtggaggacaagcaatgtttagtgacctcttcactgcatcccatagcacattcaatgtctgggaaatgttctttgtttgacaacttctgtactaaaagtgttgctgcagtagctttgtgcccctgtcagtcttggtagccccttaagatttggaaagtaaatgaactgaaatcttgttttcaatggccatattaaaattctttttttttttcctgtttcttctaaa

SEQ ID NO: 190562 - DNA, 3235 bp, Homo sapiens
  Payload ID: 17643
  Gene Name: tetratricopeptide repeat domain 31
  Uniprot ID: Q49AM3
  ENST ID: ENST00000233623
  CDS Start-End: 8-1567
agatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggtacaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaactgtcctacatagtcatgcttcccacaataggaagagaggagtgtgggtgaattggtgctgaaattcacaaaatccagagttctgggactggattctcaaagtgtgctttctaggctagcagcatcagcatcatccaggaacttactagaaatgcaatttctcaggctgggcacggtggctcacgcctgtaatctcagcactttgggaggccaagatgggtggatcacctgaggtcaggagtttgagaccagcctgaccaacatggagaaacgcctcctctgctaaaaatacaaaattagccaggtgtggtgtcacatgcctgtaat

SEQ ID NO: 190563 - DNA, 3358 bp, Homo sapiens
  Payload ID: 17643
  Gene Name: tetratricopeptide repeat domain 31
  ENST ID: ENST00000410003
  CDS Start-End: 10-1032
gtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggtacaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggtaggtgggggcttggccagggcagggcagagtgttgaggactcagacctttggccaccttctgtctttatcaggttatttggaaatcgttccttctgccatgagcggttgggtcagccagcgtgggccctggctgatgcccaggtggcccttaccctacggcctggctggccccggggcctcttccgcctgggcaaggccttgatgggactacaggtaataggtctggggctggaaacaggagagatttgagtgggatggagtggggagagggtctatgttgactttctagataagcttctagtaccaaagtgtcacaatggttgtggtactaggagcaggggccagttttagaaagggtacttttaagcaccttgacacctaatcttttctttctgatccctctgggaccaaagcgcttcagagaggcagctgctgtgtttcaggaaactctgagaggtgggtcccagcctgacgcagcccgagagctccgctcttgccttctccacctcacactggtaagggggccaggcacactgtcatgctgaggcgggtatcagggagaattggctgggactgcaataccaagcctcaggtggctaaggagggggcggggaaggatgggtggaatgagaggcatgggctctcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaa

SEQ ID NO: 190564 - DNA, 833 bp, Homo sapiens
  Payload ID: 17643
  Gene Name: tetratricopeptide repeat domain 31
  ENST ID: ENST00000414247
  CDS Start-End: 1-740
aaggcaggggtctggccctccagaagatgggtcaagaggaagagagccctccaagagaggagaggccccagcagagtccaaaggtacaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacaggaaactctgagaggtgggtcccagcctgacgcagcccgagagctccgctcttgccttctccacctcacactgggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagacctt

SEQ ID NO: 190565 - DNA, 2806 bp, Homo sapiens
  Payload ID: 17643
  Gene Name: tetratricopeptide repeat domain 31
  ENST ID: ENST00000424122
  CDS Start-End: 15-365
tcactgtagatgcgatggcgccgattccaaagactgtggggcggatcaagctagactgctctctacggcccagctgcccactggaggtcgctgctgcacccaaactttgcaaggaattcggtccagaggattacggcgaagagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggttatttggaaatcgttccttctgccatgagcggttgggtcagccagcgtgggccctggctgatgcccaggtggcccttaccctacggcctggctggccccggggcctcttccgcctgggcaaggccttgatgggactacagcgcttcagagaggcagctgctgtgtttcaggaaactctgagaggtgggtcccagcctgacgcagcccgagagctccgctcttgccttctccacctcacactgcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttcatgtcaccgaagccaccccaaccagcccctctcccagactcagagtagaaggccccatcctctcaagccccaggacccttcaaagggctgggacatcctgggacttgggctccagcatctgtctcaggccagatgagggggcaccggtccctcatagggcagggccatgtatatatcccttggtgggggacatagtgtggtgacagttcactgcatattttgagaccttattctctagatccatagttaatgatgccctggcagtcattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggtcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgacctctcttgtccagtggtctggtgctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaagctgctacaaccttggccactctgtttctccaccccagcactgggcatggtaattagcctttccccatgttaatttattcagttttttcaagggtcaactgaattccccacttcctgggtaagaagcatgatctccttttaatttcacgtctaagatcctggcagcttcccctagctggttcctctgtagtcctgctgggactgtcagctcatttaaatgtgggtctgcagaaggctttaggtctcccccaacccccttacctttcacagaggaacctttcatcaggataaatgattattgctgccctgtgggtcttgctcaatactgttcatacctggagagagaaggtattgaaacatctcctttatgtgtgactttcccaaatttttaaaaattgtttatggtttaggccccttaaatactgtgtagcaggatgaagtctaccattaccagctgggtcaccttggatgggtctgtcaacatctaagcctcagttccctcacctgtaaaaatgagggtagtccctacctcataagggatattgtgaggatggaaagcgaaagtgtgagaaaatacctcccaagtgcctggtacatagtgggtgctaaataaaccactttttgtctgcaa

SEQ ID NO: 190566 - DNA, 2161 bp, Homo sapiens
  Payload ID: 17643
  Gene Name: tetratricopeptide repeat domain 31
  ENST ID: ENST00000449459
  CDS Start-End: 10-360
gtagatgcgatggcgccgattccaaagactgtggggcggatcaagctagactgctctctacggcccagctgcccactggaggtcgctgctgcacccaaactttgcaaggaattcggtccagaggattacggcgaagagattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaaggtggctagagcatggctggagggtgcaggggagccaaagggatttgggagagggaaagaggaaactttgtgggaacaggagagagctcaagatggcctgcagtggactctcttgccaggaggacacaaggggcccagggactggggggtctctcacaggccatctggtgcagtggttctggaatcctactgtgctgcctaggtaggaatctgcctccttacatgaggcctcttgctggtgcctctcttgtctgctttttcacctgcaaaatgaggataataatgatgcctgtctcatagagctgcaaagatggaatgcgaaatcttagcccagcacacgacatacagtaagtgttcaaaatacatcattgttaccattactattgcagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccaagagaggagaggccccagcagagtccaaaggcatctccgggactgctggcagctgccttacaacagagccaggaactggcaaagttgggtaccagctttgctcaaaatggtttctaccatgaggccgtggtcctcttcacccaggccttgaagctcaacccccaggaccaccggtaggtgggggcttggccagggcagggcagagtgttgaggactcagacctttggccaccttctgtctttatcaggttatttggaaatcgttccttctgccatgagcggttgggtcagccagcgtgggccctggctgatgcccaggtggcccttaccctacggcctggctggccccggggcctcttccgcctgggcaaggccttgatgggactacaggtaataggtctggggctggaaacaggagagatttgagtgggatggagtggggagagggtctatgttgactttctagataagcttctagtaccaaagtgtcacaatggttgtggtactaggagcaggggccagttttagaaagggtacttttaagcaccttgacacctaatcttttctttctgatccctctgggaccaaagcgcttcagagaggcagctgctgtgtttcaggaaactctgagaggtgggtcccagcctgacgcagcccgagagctccgctcttgccttctccacctcacactggtaagggggccaggcacactgtcatgctgaggcgggtatcagggagaattggctgggactgcaataccaagcctcaggtggctaaggagggggcggggaaggatgggtggaatgagaggcatgggctctcctgcttaaaagaaggatctggtgcccttctctctcccttctcagcagggtcagcgaggaggaatctgtgcaccacctctgtcacctggggccctccagccacttccccatgctgagctggcaccctcaggcctaccttccctcaggtgccctcgaagcactgctttgaggtcccctggcctgtctccactcttgcattatccttca

SEQ ID NO: 190567 - DNA, 958 bp, Homo sapiens
  Payload ID: 17643
  Gene Name: tetratricopeptide repeat domain 31
  Uniprot ID: Q49AM3
  ENST ID: ENST00000442235
  CDS Start-End: 10-867
gtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggaagccaatcgcctggctgaggagctggtggctgaggaggagcgcatgaaacagaaagcagagaaaaagcgactcaagaagaagcgtcaaaaggaacggaagcgacaggagcgtttggagcagtactgtggggagcccaaggccagcactacctcagatggagatgagagccccccatccagccctggaaacccagttcagggacagtgtggtgaagaagaggactcactggatctatctagcacttttgtgtctctggctttgcgcaaggttggggattggcccctcagtgcccgcagagagaagggactgaaccaggagccccaaggcaggggtctggccctccagaagatgggtcaagaggaagagagccctccagccacttccccatgctgagctggcaccctcaggcctaccttccctcaggtgccctcgaagcactgctttgaggtcccctggcctgtctccactcttgcattatccttca

SEQ ID NO: 190568 - DNA, 822 bp, Homo sapiens
  Payload ID: 17644
  Gene Name: tetratricopeptide repeat domain 32
  Uniprot ID: Q5I0X7
  ENST ID: ENST00000333610
  CDS Start-End: 133-588
ataaggcacaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaag

SEQ ID NO: 190569 - DNA, 735 bp, Homo sapiens
  Payload ID: 17644
  Gene Name: tetratricopeptide repeat domain 32
  ENST ID: ENST00000402414
  CDS Start-End: 103-261
tgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggaggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactctt

SEQ ID NO: 190570 - DNA, 779 bp, Homo sapiens
  Payload ID: 17644
  Gene Name: tetratricopeptide repeat domain 32
  ENST ID: ENST00000431392
  CDS Start-End: 521-779
ctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacggtgcggagagatttccgggaaccaagccctctgcgcgatcctcgggcgcgggccgccgcctctcaccccgccgtctctccttccacgttcctcattcgcacccagagacttaggacagataggaattttccactcgtgattttagctggcgggaaatccgcgacctgggaagggaaggggtcacggctgcgtagggccacagtaccgcgactcccatctcagtgtcacggcgcaggctcttggtggtgtttttcacttgtgaaaaacgtttaaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgg

SEQ ID NO: 190571 - DNA, 2612 bp, Homo sapiens
  Payload ID: 17645
  Gene Name: tetratricopeptide repeat domain 33
  Uniprot ID: Q6PID6
  ENST ID: ENST00000337702
  CDS Start-End: 154-942
gcggtgacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgagatgaaatcacaggtgctaatgtctcttcatgaaatgttcccagcagtacatgcagcagaaatggccgtccagcaaaatccacattcatgggagtcttggcagactttgggacgtgctcaacttggtttaggagagataatcctggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaacgcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattgtagtacaataatatagaactgttgggttctgttacttctgacactcaggaagatactattggtgtattaattttatctttgttagagatgaaagtagcccactttatgttaaagatcttactactgttggagcttataagtaatgatctacattttttatgaagatggtttttaaaacttttgttttattggaatgcatatctcttttcagggttggagaaattagcacttgccttgaaaagaatattctttccttaagttatatcatcagaaaattagctctggttagagaggttagtttcagagtgctccaaaaaatatgttaattattttattttgtttaataaagaacattctcaaaacgtaaataggtatctagagaagtgagtactcaacatttggtatattgttttgagtaatggatgtttgttttttgtgtaatttgtgaataaatagtttttttctgca

SEQ ID NO: 190572 - DNA, 7257 bp, Homo sapiens
  Payload ID: 17646
  Gene Name: tetratricopeptide repeat domain 34
  Uniprot ID: A8MYJ7
  ENST ID: ENST00000401095
  CDS Start-End: 165-1865
ggggactgctgcgggtgctggcgggcagcgcgttcctgggcacgctggactatgtcaccgcctgcaggctgcggcccgaggaggcgctgctggccgccaaggcctacgtgccctggaaccagcgggggctgctgctggtggtgctgcgggaggaggcccgtgggatgctgcagcgatctccacgcgccgggccgtccagagcgcagggccggagggaggccgcagagacgggcggccccaccacgcaggagggggtcgcctgcggcgtgcaccagctggccacactgctgatggagctggattcagaggacgaggcctctcgcctcctggcggctgatgccctgtaccgcctgggccgcctggaggagacccacaaggccctgctggtggccctatcccggaggccccaggcagcccctgtgctggcacgactggccctgctgcagctgaggaggggcttcttctatgacgccaaccagttggtgaagaagctggtccagtctggtgacaccgcctgcctccagcccaccctggacgtcttctgccacgaggaccggcagctgcttcaaggccactgccacgccagggccctggccatcctgcgggcacggccaggcggggccgacggcagggttcacaccaaggaggccatcgcctacctgtctctggccatctttgccgcaggaagccaggcaagtgagtccctccttgcccgagcccgctgctatgggttcctgggccagaagaagacggccatgttcgacttcaacacagtgctgcgggctgagccggggaacgtgcaggcactgtgtggacgggcgttggtgcacctggccctagaccagctgcaggaagccgtggacgacatcgtctctgctctgaagctcggccccgggactgtggtccctgagctccgctctctgaagccggaagcccaggccctcatcacacagggcctctactcccactgccgggcccttctgagccagctgccagacactggggcccctctcgaggacaaggacacccagggcctccttgctgtgggggaggcgctgatcaaaatcgactcagggcaaccgcactggcacctcctcctggcagacattctcatggcacagggcagctacgaggaagctggcacccacctggaaaaagccctgcaccgtgccccaacgtcagaggcagcccgggcccggctgggcctgctccagctcaagaagggagacgtgccaggggctgcaagggacctgcagagcctggccgaggtggatgccccggatctcagctgcctgctgcatctcctggaggcctcggagcggcagagccttgcccaggcggcggcccaggaagccggcaccctcctggacgcagggcaacccaggcaggcgctgggctactgttcgctgtctgtcctggccagtggcagcagtgcctgtcacctgcgtctgcgggccacctgcctggccgagttgcaggagtttggccgggcccttagggacctggaccatgtgctccaggaggcgctgggggatggtgacctcccaaggcgggcagaggacttctgccgtcagggtcgcctgctgctgagcctgggggatgaggcggcggccgcaggggcctttgcccaggccctgaagctggcgccctccttggcccagaacagcctgtgcaggcagccaggccgggcccccactgcacgcatgttccttctccgcgggcagtgctgcctggaggagcagcgtcacgcagaggcctggacggcggtagagagcggcctcctggtggaccccgaccaccgtggcctgaagagactgaaggccagaatccggagggaggcatcctcaggctgctggctacagtgactgggcctgaccctctcccagccctaatcacggggccaccctagcatctgcacctgatgtccaggcccaggggtgtacccagctccctaaatcggggaggtacctgccctgccctctccacacccccttcccagccctccccacacaccccttcccaaccctccccacaaccccccttcccaaccctccccacagccccccttcccaccctccccacacaccccttcccagccctcccccttcccagccctccccacaccaccttcccagccctccccatacctcccttcccagccctccccatacctcccttcccagccctccccacaccccccttccctgccctccccacaccccgcttccctgccccagcatgagtcagtgttggacagccagcctcacacctctgccttgggaaggacaggggacagcttcctacttgcatgaagggaccatcctagaagcttcacagtcccttctaccaccagcaacctggtccctgcagttggggccctcttggcccacacctggggctcagaccttgaagaagcagccccaggtctcgtccctggcctgggatcctacaggttggacaggtttgaggccagactcctggggcccttggggagatggtaccagccccagaagcccctccctgggtgtgaagctgcgttttgcttggaccctgagccttgggccagcctccagtagagcctgagccctctccagagacagagctcccaaatgggcccagccagcccataccccaagctgacctttcagggtgctttcatgggggcccttcatcgagaatccagtgtgctgggggtaaacttcctccctcctccacaggcccctcccttccaagcagagggaccaccgaggggccctgatgagcacagtccccaggctcccaccagacctgtctcccgaagctgctgggaggtatcagtgcttccacagagcgagagaacagcttgttcttatacgtgcgttaaatgtccccaggccttgcagctgccagtgagcttggggacttctgggtggggcagaggcagccagcctttgcccatcactgtgagtgtcacagactgaggcctcagcccggggctttctctcatggccatgggcgagagacatgctgggtgagctgactcggtgcaaaacgtgcccccaagccctgcctgacttcaccctggggagacagggccacgaccccccctcctggcttctctctcctcctgggcacttgcatttgtcccatttctgtccccttctctgccgcttccttccatggtcttgaacccacagatagaccccctgcctctccacccacttcgcttctgggatcatctgacgaaccccagtccagggggtcaggcagggaggggccctattcctcgccctgcatggaagtggggcccccaggcggcaggtgcagggctgggtagcccccctcctcctcaggcctcacccactcctcaacccccatgcaccttcatcagctggcaccgcctatgtgtctctggccacaggggtctgggtaaagggtcagtgcctcccaccttgagtacctcggggatgggcagcccacagtgggagagggccctgacagggaccttcagccccgctcctcgccttccccgctcggaatcttcacgcagtccccctcttccggggttccccagcgcaggcaccaatttgatccatcttccgcctgccagctccccatccacccttccctccctgtcttcacccgtgtgctcaaggactcaacaaacacctgtcagcagcccaagagctaagttcagggacacgcaagttcctcgggtcaggtgggccagtcggcactgaggcagaggaggcaagggctggtccagagagcctggtcacagcagaagggcctgctccaatgtcggggccaggtggaggcagtggggaggcgtcccctaggggtgcccttccccaccacgttccctgctcctaccgtcctcctcgcctgggatgtcctgccccatccatccgtgcaaggctgagtgtagatgccagccccgctgaggctcctcctggacctcaggatcgctgtgtttctcccccaccagggggctgccccctctaccaccagctcacccagcaggtatctctcatcagcctttggcctggctccttgctgggctctgaatgtctgcattcccccaaactttatgtgttgcgatcctaacccccaaggttatggtatcagaagtggggcttttgggagatgaccaggggtggaacctcatgagtgggattagtgtccttataaaagagaccccagagttctcccaagcccctccaccatgtggagacccagtgagaagctgtctgtgaaccaggaagggatcctcactagagagcgagctggcaccttcatcttgggcttccagcctccagaactgtgagaaataagtatctgttgatgaaccacctgtctctgctattctgttggggcagtccagatagacaaagacatgcccgttcccgcggcccaccacctctgccctgagcacagtgggtgagtctcggttccccttatcccatccctgctggggtccagccctggcttttcctgaggtagtttctccaggaccaagcagacacccacaaccagcagcccttaaggcatggacgcactcgtccctgaggcctgggtgtcccgcctggaggggcatgtccacagctgctctgggtcctgacgctccaggagctcacgctgtctgcagatccaccacttccctgggcagtccccggcctgcgtcttcctcagtgctcagctggaggtggagagaaatcaggctgggacggagggtggcccttgctttgcacgattcctgcctcgacgttacaccagggacattccagcatctccccttcattaactgtagaccgccagcaaatccagatttcattcaaccaagtaaactggtagagtcatttccagcagctaatgtgagctagcgcattaaattcagaatctctagtaagtgtacctgcatcaataaagccaagccggtccagctgcattaataccctaccctccattcccacacggttcccaggtctccgtgtgtgaatttgtaacatcttacgagcattttggtgtgaaagtggttccttcctgagtcaggctttgtacttgacccttcccctccctgggagtacactgaggttctagaggcaacagggtggctatggtggttaaataaaatgagcatcatttctaggcacctggccaggtaagcttatcacagcattttcaagcagaacaaaaaaaataaataaaggctactctcagatcttggaggacaagctgcttcccctggaaggagaggctcagagaaccagggggttcacaattctcagcttcatctgagcccaaccagacatccccatgccaagcttcagcatccagttccttcccactcagtgcccacgtttcagtagtgaggctgtgagtgtgagccacacagcagtcacacaactcagagttaaactgtgcatccgagttgtagcagcagcagccccgaggctctcaggaacaagggactcttccatggccatggcagtcctgattctctgtctatgacttaaactgagtttagagacctgaacgtgtggttccttcctgttagtgctgctggacactcaggggaccccccacagccctcgtggttgtggtcatcctcgtggccgtgacagcctcacacagcagcacgtgggttcccgaggccctcaattctgctggtgcctcacagccagcatgggggatggcttggttaactgtgaagctcccccaacaacactgtgggccaacagcctccccttcccactggccaggagatcggcctgcagcccagcccaagcaacaaccacactaacctaatccccggaccccaccttttgatagtgacaggaggcagacaaatcctaggcagacagggacaggttcccagtgaaaccccacctccgagccaaagacagtttaaagcctgaaagccaagctacaaattaaatcctcagcctggattgagaacccatcttcccatttggctgctttcctctgattgatccccacccttcacctattttacatgtacctatcttttcctaattcattttctacactggcatgcccacctttgagtggtacctttgtttaagccttttttgcataatcagaagccaatcagcatgcactcccccattctgagcccataaatgccccggacccagccacactaggagagaaaccacctgacttcaggtcgggaaccacccgtgcatcccctctctgctgagagctgttccgtctctcaataaaattcttctctgcccttctcacacttcgattggcagcatctcctcattcttcttggacacgggacaagaacttgggaactgccatacatgggtacaagctataacacaagcaggctggaacatgcccagcccagccacaggctgagctggtgaacagccaggtgtggcccaggcaggctgagtgggtgggccacctcctgcggcaggtagcatggccaagagaggcctggggagggggggtgtcagcagccagaggtacctggctggcaaagtgaccaaagaggtacctgactgtgtcactttgagggcctgtctctggggaccccctcctagtatgaatttatgtatcagttggggtctacttgggagatggaaaccacaacagtgattctaatagcatgaatttaatgtgcagaatttttcattagttctgggtaaaaacagctctagggaatcatggaggttgcaaccacaaaattcagagaggtgacctggctggcgacactggtgataatggtcacctgccatgcagcctttcagctcaggtgggcacactcctctgcccctgcccacttcctctcccaggtgaatcttgaccacacctgtgcctggcactgtgcacacattctctgttgttcaactctgcgatcaatctggaaaaaaaagaaaaaaaaaaaacctttttaggagagtaaaaggaaaataaatcttggggccccaaaatcactaagccaaagggaaaagtcaagctgggaactgcttagggcaagcctgcctccaattccattcaaagtcattcccccgctcgctgagatagatgcatatctgattgccttctttggaaaggctcatcagaaactcaaaagaatgtaactctatcttacatgtgttgattgatgtctcatatctccctaaaatgtataaaaccaagctgtcctctgaccaccttgggcacatgtcaggacctcctgaggctgtgtcacaggtgtgcatccttaattttggcaaaataaacttcccaaattggctgaga

SEQ ID NO: 190573 - DNA, 1826 bp, Homo sapiens
  Payload ID: 17646
  Gene Name: tetratricopeptide repeat domain 34
  Uniprot ID: A8MYJ7
  ENST ID: ENST00000611612
  CDS Start-End: 125-1825
cacgctggactatgtcaccgcctgcaggctgcggcccgaggaggcgctgctggccgccaaggcctacgtgccctggaaccagcgggggctgctgctggtggtgctgcgggaggaggcccgtgggatgctgcagcgatctccacgcgccgggccgtccagagcgcagggccggagggaggccgcagagacgggcggccccaccacgcaggagggggtcgcctgcggcgtgcaccagctggccacactgctgatggagctggattcagaggacgaggcctctcgcctcctggcggctgatgccctgtaccgcctgggccgcctggaggagacccacaaggccctgctggtggccctatcccggaggccccaggcagcccctgtgctggcacgactggccctgctgcagctgaggaggggcttcttctatgacgccaaccagttggtgaagaagctggtccagtctggtgacaccgcctgcctccagcccaccctggacgtcttctgccacgaggaccggcagctgcttcaaggccactgccacgccagggccctggccatcctgcgggcacggccaggcggggccgacggcagggttcacaccaaggaggccatcgcctacctgtctctggccatctttgccgcaggaagccaggcaagtgagtccctccttgcccgagcccgctgctatgggttcctgggccagaagaagacggccatgttcgacttcaacacagtgctgcgggctgagccggggaacgtgcaggcactgtgtggacgggcgttggtgcacctggccctagaccagctgcaggaagccgtggacgacatcgtctctgctctgaagctcggccccgggactgtggtccctgagctccgctctctgaagccggaagcccaggccctcatcacacagggcctctactcccactgccgggcccttctgagccagctgccagacactggggcccctctcgaggacaaggacacccagggcctccttgctgtgggggaggcgctgatcaaaatcgactcagggcaaccgcactggcacctcctcctggcagacattctcatggcacagggcagctacgaggaagctggcacccacctggaaaaagccctgcaccgtgccccaacgtcagaggcagcccgggcccggctgggcctgctccagctcaagaagggagacgtgccaggggctgcaagggacctgcagagcctggccgaggtggatgccccggatctcagctgcctgctgcatctcctggaggcctcggagcggcagagccttgcccaggcggcggcccaggaagccggcaccctcctggacgcagggcaacccaggcaggcgctgggctactgttcgctgtctgtcctggccagtggcagcagtgcctgtcacctgcgtctgcgggccacctgcctggccgagctgcaggagtttggccgggcccttagggacctggaccatgtgctccaggaggcgctgggggatggtgacctcccaaggcgggcagaggacttctgccgtcagggtcgcctgctgctgagcctgggggatgaggcggcggccgcaggggcctttgcccaggccctgaagctggcgccctccttggcccagaacagcctgtgcaggcagccaggccgggcccccactgcacgcatgttccttctccgcgggcagtgctgcctggaggagcagcgtcacgcagaggcctggacggcggtagagagcggcctcctggtggaccccgaccaccgtggcctgaagagactgaaggccagaatccggagggaggcatcctcaggctgctggctacagtgac

SEQ ID NO: 190574 - DNA, 874 bp, Homo sapiens
  Payload ID: 17647
  Gene Name: tetratricopeptide repeat domain 36
  Uniprot ID: A6NLP5
  ENST ID: ENST00000302783
  CDS Start-End: 24-593
ttgggattttggagttgagcaccatggggactccaaatgatcaggcagtgctgcaggccatcttcaaccctgacaccccatttggagacattgttggattggacctcggagaggaagcagaaaaggaagaacgagaagaagatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacct

SEQ ID NO: 190575 - DNA, 986 bp, Homo sapiens
  Payload ID: 17647
  Gene Name: tetratricopeptide repeat domain 36
  ENST ID: ENST00000533501
  CDS Start-End: 24-170
ttgggattttggagttgagcaccatggggactccaaatgatcaggcagtgctgcaggccatcttcaaccctgacaccccatttggagacattgttggattggacctcggagaggaagcagaaaaggaagaacgagaagaagagaataccaccaccagaacagaagactgaaataaggcagggcatggttgctcagttgagtggttccaatatagcaagcacaaccagtaaccgttaaacactgtcacaagccaagctccaaactaactcttccgcactggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacct

SEQ ID NO: 190576 - DNA, 1009 bp, Homo sapiens
  Payload ID: 17647
  Gene Name: tetratricopeptide repeat domain 36
  ENST ID: ENST00000528570
  CDS Start-End: 24-170
ttgggattttggagttgagcaccatggggactccaaatgatcaggcagtgctgcaggccatcttcaaccctgacaccccatttggagacattgttggattggacctcggagaggaagcagaaaaggaagaacgagaagaagagaataccaccaccagaacagaagactgaaataaggcagggcatggttgctcagttgagtggttccaatatagcaagcacaaccagtaaccgttaaacactgtcacaagccaagctccaaactaactcttccgcaatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacct

SEQ ID NO: 190577 - DNA, 5706 bp, Homo sapiens
  Payload ID: 17648
  Gene Name: tetratricopeptide repeat domain 37
  Uniprot ID: Q6PGP7
  ENST ID: ENST00000358746
  CDS Start-End: 300-4994
atgagtcctgggaaaggcgcatgcgctctcattgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtttgggtgaatgccatcttatgatggcaaaagcagctctagttgattatcttgatggaaaagccgtagactacatagaaaaagcactggaatattttacttgtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacattgtctgaaaaaagcagtgagactcgacagtaataatcacttatactggaatgctcttggtgtggttgcatgttacagtggtattggaaattatgcccttgctcagcactgtttcatcaaatcaatccagtcagaacaaattaatgctgttgcatggaccaacttgggagtgttatacctcacaaatgaaaacattgagcaagctcatgaggctttcaaaatggctcaatcccttgatccatcttatttaatgtgctggattggacaagctcttattgctgaggcagttggaagttatgacaccatggatctcttcaggcacactacagaactaaatatgcatactgaaggagcattaggttatgcgtattgggtctgcacaacattgcaagataaaagcaacagagaaacagagctgtaccagtacaacatcctccagatgaatgctattccagcagcacaagttattttgaataaatatgtagaaagaattcagaattatgccccagctttcacaatgttgggttacttaaacgaacatctacaactgaaaaaggaagcagcaaatgcataccaaagggcaattttgttgttacagactgcagaagaccaagatacttacaatgttgcaataagaaattacggcagattgttatgttccactggtgaatatgataaagctatccaggcttttaagtcaacaccccttgaagtgttagaagacatcataggttttgcattggctttattcatgaaggggctttataaagagagcagcaaagcctatgagagagccttgtctattgttgaatcggagcaagacaaagcccatatcttgacagctctggcaataactgaatataaacaaggaaaaacggatgtagccaagacattgctatttaaatgctctatcttaaaggaaccaaccacagaaagccttcaagccctgtgtgctctagggttggcaatgcaggatgctacactgtcaaaagcagcacttaatgagttactgaagcacatcaaacacaaagacagtaattatcagaggtgccttcttacatcagcgatttatgcactccaaggccgcagtgtggctgtgcaaaaacaaatatctaaagctgttcacagcaaccctggtgaccctgctctttggtctctgttgtctcgagttgttgcacagtatgctcaacgaaatgcaaagggaggtgttgtagcaggaaatgtggctcatattctggactcaaatcatggaaagaaggcattactgtacactgcggtaaatcagttggctatgggaagcagttcagcagaagatgaaaaaaatactgcactaaagaccattcagaaggcagctctcctttctccaggtgatcctgctatctgggctgggctaatggcagcctgtcacgctgatgataaactggccttagtgaacaacactcagccaaagaggatagatttatacttggcactgttatctgctgtttctgcttcaattaaagacgaaaaattctttgaaaattacaaccagtcccttgaaaagtggtctctctcacaagctgtcactggtctaatagacacaggaagaatatctgaagctgaaactctctgcacaaagaatttaaaaagtaaccctgatcagccagccgttatcttacttttgagacaagttcagtgtaaaccactcctggagtcacaaaagccactcccagatgctgtacttgaagaactacaaaaaacagtcatgtccaactcaacctctgttccagcttggcagtggctggcacatgtgtatcaatcccaaggaatgatgagagctgcagagatgtgttacagaaagagtctacaattggcatcccaacggggcagttggagtgggaagctctcaagtctgttgagactagcactacttgcattaaaagtctgtatggctaacatttccaatgatcactggccatctttggttcaagaggctacaactgaggccttgaagctttgcttttgtccactggctgttcttttacaagctttgttacaattcaaacgcaaaatgggggcaagagagacacggcgtcttttggaaagagtggtatatcagcctgggtatcccaaatctattgcatcaactgcacgttggtacctactgagacacttatatgccaaagatgactatgagcttattgacgtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagactagactctaatggatatgtttatataattccaaacactcaggtgtgtgaatgcatttaaaaacattaatggaaaataatgctgataatatttaattgatcatgcaattccttcaattatgatggaaagacttgaactttctgaaataaaacaaaaatacagc

SEQ ID NO: 190578 - DNA, 797 bp, Homo sapiens
  Payload ID: 17648
  Gene Name: tetratricopeptide repeat domain 37
  ENST ID: ENST00000513232
  CDS Start-End: 1-102
gataatatcccaggacttttggttctcaaaagcttggcctatcggaacaaaggttcatttgatgaagctgcaaagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgagcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaag

SEQ ID NO: 190579 - DNA, 664 bp, Homo sapiens
  Payload ID: 17648
  Gene Name: tetratricopeptide repeat domain 37
  ENST ID: ENST00000505578
  CDS Start-End: 1-393
acacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcatt

SEQ ID NO: 190580 - DNA, 2102 bp, Homo sapiens
  Payload ID: 17648
  Gene Name: tetratricopeptide repeat domain 37
  ENST ID: ENST00000514952
  CDS Start-End: 270-2102
attgcagcctcggcgtttgtagaagaggagcatctgctccagatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaaggggttagcaaacttgtatgagaaatataatcacataaatgctaaggatgacttgcctggtgtttaccaaaagctcctggatctttatgagagtgttgacaagcagaagtggtgtgatgtctgcaagaaacttgtggatctatattaccaagaaaagaaacacctagaggtggctcgaacatggcacaagttgataaaaacacggcaggaacaaggtgcagaaaatgaagagcttcatcaactatggagaaaattgactcagttcctggctgaaagtacagaggaccagaataatgaaactcagcaattgctttttactgcttttgagaatgcactgggattatcagataagattcctagtgaagatcaccaagtactttataggcatttcattcagagtttatccaaatttcctcatgagtctgctagattgaagaaggcctgtgaaggaatgataaacatctatcctactgtacagtatccattagaagtgctttgtttgcatttaattgaatcaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaagggttaaaggaaagccctgtctgcacaagtggatggtatcatctggcagaagcccaagtcaaaatgcatagacctaaagaagctgttctttcatgcagtcaagctctgaagatcgtagataatcttggtgcgtctggtaacagtctttatcagaggaatctttgtcttcatttgaaagcagaggctttgattaaactctcagattatgactcttcagaggaagcaattcgtacgcttgatcagatttctgatgcagataatatcccaggacttttggttctcaaaagcttggcctatcggaacaaaggttcatttgatgaagctgcaaagattatggaagaccttctctcttcttaccctgacctagctgaagttcatgcccttgaggctttgattcatttcaccaaaaaggactatctacaagcagaaaaatgttttcagagagctcttgagaaagataccgaagttgcagaatatcattaccaacttggattaacatactggttcatgggtgaagagacaagaaaagataaaacaaaggctcttacccactttctgaaggctgcaagactggatacatatatgggcaaagttttctgctatttaggtcattattatagagacgtagtgggagataaaaacagagctcgtggatgttataggaaagcctttgaattagatgacactgatgctgaatctggagctgcagcagttgacctaagtgtggagcttgaagatatggaaatggctttagctatcctaacaacagtaactcaaaaggcaagtgctggaacggcaaaatgggcctggcttaggcgaggactatactatttgaaagctggtcagcattctcaagcagtggctgatttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcatt

SEQ ID NO: 190581 - DNA, 577 bp, Homo sapiens
  Payload ID: 17648
  Gene Name: tetratricopeptide repeat domain 37
  ENST ID: ENST00000513823
  CDS Start-End: 292-577
ctgctccaggtgggtttggatttctgtcggttttgcacaagggatcctaaaggcgattgaaatgatggaaaatgggtaaggaacaatcaaattcaattcgggaagaatatagaggtggtaataattggtaaaagtctgcagggttttttttaaccaaaggaaactggtttgagaaaattgtgaaatcagcattgaaatttgttacctactccaatcaagatttgcaaactacaaaaaaatcattctgaagctttcacctataaatatataccaagataatttcagataagaatgtccagcaaggaagtgaagactgctctaaaaagtgctagagatgcaatcagaaacaaagaatacaaagaagctttgaaacactgtaagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggggttagcaaacttgtatgagaaatataatcacataaatgctaaggatgact

SEQ ID NO: 190582 - DNA, 2610 bp, Homo sapiens
  Payload ID: 17649
  Gene Name: tetratricopeptide repeat domain 38
  Uniprot ID: Q5R3I4
  ENST ID: ENST00000381031
  CDS Start-End: 77-1486
tttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccttctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaa

SEQ ID NO: 190583 - DNA, 630 bp, Homo sapiens
  Payload ID: 17649
  Gene Name: tetratricopeptide repeat domain 38
  ENST ID: ENST00000417709
  CDS Start-End: 80-241
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccaggactctgagtggtgggtggacagcggtgggtgcagtggggatgttttttgaggatgctggcctccccgggcctcccattgtggcctgctgagggtctgatgcagggctcggctgcttaggacgtgggatcctgtcctgggatgaatcttatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattc

SEQ ID NO: 190584 - DNA, 582 bp, Homo sapiens
  Payload ID: 17649
  Gene Name: tetratricopeptide repeat domain 38
  ENST ID: ENST00000451998
  CDS Start-End: 1-359
acttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccgaggcaaggtctcactcggtcatccaggttggaatgcagtggtgtgatcacagttcactgtaaactcaaactcctgggctcaaggaatcttcctgcctcatccttccatcgtgcagggattacaggggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactg

SEQ ID NO: 190585 - DNA, 828 bp, Homo sapiens
  Payload ID: 17649
  Gene Name: tetratricopeptide repeat domain 38
  ENST ID: ENST00000422713
  CDS Start-End: 1-629
tcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccttctggaagggcctggtcaggaggagcgagcagcctcttcaaagcacatgagctgcaccatgacggggaccctctgtgggatgtggaaacgcagaggaagcattaaactcaactgggcttggggggacagtggctagggaaggcatcctggagggggcaacctctgagttggctactgaaggatgagcaggactctgatatgttggcttgtcataactattggcactgggctttatatctgattgagaag

SEQ ID NO: 190586 - DNA, 821 bp, Homo sapiens
  Payload ID: 17649
  Gene Name: tetratricopeptide repeat domain 38
  ENST ID: ENST00000421359
  CDS Start-End: 33-821
agagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggcaccaactctttgtcttcaacaccagcaccccacagacaactactgggcaggaaaagcaggctgtgatggggccaggagtggtaacacatgggctctgtgtctgcagccccaggctggtgagggtaggaggagccagggcaggagcaggcaggcggcaggcacaggcacagcc

SEQ ID NO: 190587 - DNA, 162 bp, Homo sapiens
  Payload ID: 17649
  Gene Name: tetratricopeptide repeat domain 38
  ENST ID: ENST00000629918
  CDS Start-End: 1-162
atggccgcagcctcgcctctgcgcgactgccaggcctggaaggatgcgaggctcccgctctccaccacaagcaacgaagcctgcaagctgttcgatgccacgctgacccaggactctgagtggtgggtggacagcggtgggtgcagtggggatgttttttga

SEQ ID NO: 190588 - DNA, 2173 bp, Homo sapiens
  Payload ID: 17650
  Gene Name: tetratricopeptide repeat domain 39A
  ENST ID: ENST00000262675
  CDS Start-End: 176-1828
cacgttcagagcagccttccccacctgcctcgtggcgttcactcctgtggggtgggccctgttactctcatccccattacagatgaggaaactgagacacagcacttaagtgacttgtcatcggtcacccaggaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatc

SEQ ID NO: 190589 - DNA, 6287 bp, Homo sapiens
  Payload ID: 17650
  Gene Name: tetratricopeptide repeat domain 39A
  Uniprot ID: Q5SRH9
  ENST ID: ENST00000262676
  CDS Start-End: 162-1424
gtgccagaagatcaggtcaggtggagacaccgcctcagggctcggtgcacagtggacatttggggagcgttgtgggtgacccccacacaggcactgggaatgcaggggagagggggccaagggggaaaggggccagagtgttggctttggattcaggagggatggattccagtcctagcttgccacttattaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagtgagtgatgggggtccgggccggggctggggatccctcggggtctcccagaccagcaggaagtcaggcacatgtgacatactcagggacaggatagactgggggcggggggggggccaagagagaaccaaccagagagcaggggcaggagaggcccttctggcagagcagcctgggaagacaagggaggaggaggcatttgtggtgcctgggattttgactgggagatataggactgcagcattgcagtggagggaggtggagggaggtgcttgagggaggcagaggttaggaaagcccatctgtttagggcatgacgattaggctggagtctggtacctcccctccattatagctctctcctgctctttcattttgttactaaaaaccagagtcctaggcgggggctgtatttgagcccaacgtcatgtaagacttaggaggtaaaaccaggactggaggccagatctcctggctcctggggccccacctgagcctagcacagggctggaccactatgccctggaggagtcccggtctgctgtggtgttgggaggttcggaggatgcagaggggttggggctgggtgggcacccgtcaggctgaccagaaggtgcctgcaggccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggtgggctgatgccacgtgttaggggcattgggtgaccagggctgactgtgtgcctccagaccacgggccaaatccctaactgaacacagatgtctcagctggaatctaaacataaccttaaattctaataggactcaggcttggaaggaactaaagaccacaagagaaacttctgaaccacaatgtgtcacaaagagatttctagtcacaaaggacagaaacatggctccctctgtccagtagaactgtttctgtggtagaaatgttctacttatgcactgcccaaatatggtagtcaccagccacatgtgcacaatgagcacatgaaatgtgcctagtgcaactgggaaactgattgttttcagttttatttaattttaattaactaaatgttaaatttaaatagccatgtagggcttgtggccactatattggactatgcaggtccaaaacacaaaaggctcatataactgaacattcttggcacatccgacttcaggtagggctggatccaggaattcaaatgatgtcgtctggcttggtctttccatttgtggctgtgctctctcctatgacatctttgtttctgctgcatctttgcaggaaggttctctccatgtgacaggcaaggtggccacgggctgcttctactcatatcctccccttggtttcaaccagagtcccacagtttgagcctcactggtctgacttgtcacctgccaatgcctggaacagaggggtgggaagattcctcatgggctgagagtaggagaggggtggttccacagaagaaaatgatgcacccagaaatagtggagggattaacaagatgccatacaggcaaaacaaagccaaacagatgcccgcctaccaaagatgaaatttatcatggtaagtattgaaataagtgttagcttgtaccatcatagtaatgatagtgcagaaattggaaccaagagtcttacaaccacctagctcagcaaacgtctaatctgttatttgtaaatacacaggacatgtgtcttcatggcttcatcccctgcccatagcagacattgctaatcaatcctctgccatgagcctagctgtgaccttagataccttccctgcaaagctccaggcagccgttagaactgacccacattggcacctgttaggagacctgtcatctgcatctggtccctccccctcctctgcatggaggtctcttccgtagccctgcctggggaccaagctgaaggggaattctctgggtctggggcaggtggggctggggaagggagcaggcttctactgagctctcaacatgtctggcacctgtcatgtcctccacaccacacccagtgaggagaagttattatctccattgggcacatgagggccactgatgctaagcgaggactgtgactttcccacccacatggctgttggtgacagacaccggatttgaggacagtcctgtgtgactcagaggcctctgcttctctcttgctcctagagtcctcctgaggagtcggggcttgccctgagcccaccctgctgttgaaggtgcttcctcaggcccagctcccatggcccccacaccccctcctcatcacctcctactcccaaaaaggacaaagcctcagggaaccttttttctttttttagagacagggtcttgctatgttggtcaggctagtcttgaactcctgggcccaagcaatcttcccacctctgcctcctaaagtgctgggattctgggccttagggaacctttttgaactgaaagtgactctcgaagccttcctgtagagtgaggtgggtggctggggctaaccatatggggaaggagagacctggtgggggcacacagctgctatatagaggaacagaaggtgggccaggcctcccagctgtcaggaaatctggctcagtccccagaccgctgtgtggctttggggtggccagtccctctctctctgcaacactctcctcatgaggacttctgtgaaaaatgggggttgtaaccctctgagttctggggccccacccatttctaatctccagaacttggccaccacagactccaccaacttctagtcctggggcctgggcctctggccattgccataggcaccacctgctctgtgcaggcagcgcccccctctgccaggatcctccgaggtcagctgctgggtctgacccgcagaccctggctgagcgacggatgaacggagtatgcagacacaggcttgcctgtcagcagatgggggacccctgccagagtcagcagcggcccccataagcctgccacgcttgcatttatttagtacagatgtaatgacaaaggcctaaagcaaactccatttgtgggtaattaacattgtcgcccccccagaaagagcagtcctccgcatgatgattaaaggccaggttccgaggcctaagtaaaccaacttatctagatcaattcccttacttcttgttatctactctgagagaattcagctgccttcagccaaatcctttcccgaagcttttgcaaaacctccgagccttccaaggtttgcttctttctgtaatttttctcaccaccctgacctatctcctgcagtcagccctgtggaggcctttgtgtttcccccagtgctggcagcctagaggctgagatggccagaaacaaggtggtgacagtggcgtgctcagggcttgggaaacccaaggagctaaaggcatgcccaggcaaccaaagaggacaggaaggcttctgaggagagacctctgaggtgggtcttggagaggaaggacttagggaggcagagtggaggaagtgagaggacaccccaagccaagagggcggcaggaccaaaggctcagaagccagggcgctgcagaggggctgtgtgccacagggtgaagagtttgtgtggcagaagggcagggggcttgcatcaggggtgacagctgctcttttgtcccagcatagcccctgtacatccctggagagctggggcgtccacaactctaagtcacagcccccatcctaaccctggtggtgcagtgagggtgagctgtctgtgggcaggagggaagactcttggagatgagcctggtgaagggataatggcatcccgggccgaggagcagcacaggcagaggcctggggagagtttaaggagtgtaggggaggaaatggcagaagatgagccagaaaaagaaaggttagggcaggtcctggaggacatgagtggctgtttgggctttatccagcagtgggggagccttggcaggcttgtggcttagataggtgctttagaaagcccaccagcagttgctgggccaccccgctggctgggtcctgttctaaggcaggaaatacaagcatgagcaggaaaagaccccctcaaggctcacgtcctagtggggagacaagaaacacagatgggcaatataacacgatgtctggttccagtaagtgcagtgaagaacaagcgaggctggatgcagggagtgatgggaggggctttgtaaggggaggtcgggggaagcctgtctcagaggacaccagaatggagcgcaggagcagcacgtggcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggtcagtgtgcgaaatggcttgcaggggacaggagtgggagcagggagataggagacaatgtgtaccaggacagcagaaagacatcccgggtagcctggaacagggagacggtgtggagatggtggcagtccgataatgagagccgtagggcaaggccagcaggatcctagagtgagacgggaggtaaagtcaccgggacttggtgtctccacgtcaggggcaggggaaagggagaggacaagggtgacccgggaggttaaagatgggaccggggccagacgcagtggctcatgcctgtaatcctagcactttgggaggctgaggcgggcggatagcttgaggtcaggagtttgaaaccagcctggccaacatggtgaaaccccgtctctactaaaatatacaaaaattagcctggcgtggtggtgcatgcctgcagtcccagctattcaggaggctgaggcaacaagaatcgcttgaacctgggaggcggaggttgcagtgagccgagatcgcgccatagcactccagccttagcctgggcgacagagcgagaccacatcaaaaaaaaaaaaa

SEQ ID NO: 190590 - DNA, 1876 bp, Homo sapiens
  Payload ID: 17650
  Gene Name: tetratricopeptide repeat domain 39A
  ENST ID: ENST00000371747
  CDS Start-End: 86-1366
acagcgcccggctcggggttgcggcggcagcacctgggccgcgattggcgtccggctggggcagcgccgcccgcgcccctcggcgatgacctcggctggcggcgccccaggagccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcggtgggtcccacatcgtgctcccactgtgtaggccactcccaccgtgtaggccgctatggacagaccagccaggccaccctgagctgtgggcactggggagggaggagtagggtggctccctgcccccacccgcggactgccccccctgcgtgtcctcccctcccatcaccaccccatgctgctgctgctggtggttggagccctttgactttcttcagaggctttctttcacagaaatggttttgctaatatcgtcttcctccgagtctctttcatgtggacagtaggacagatgtggctccaaggtccagggagggaaggtctttcactctgctgagttaacctgagacactcagagaagcacagtagagagctgacagtcggaatcgaacaaacaagagtaaacccagcctctgcttgttcttagctgtgtcaccttggacaacttcagcatctgtaaaatgggaacaacaacctccacctcgcagcactgttttgcaaatcaactagataataaatgttaagagcctggcgcatagaa

SEQ ID NO: 190591 - DNA, 2021 bp, Homo sapiens
  Payload ID: 17650
  Gene Name: tetratricopeptide repeat domain 39A
  Uniprot ID: Q5SRH9
  ENST ID: ENST00000371750
  CDS Start-End: 98-1834
cctgggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcct

SEQ ID NO: 190592 - DNA, 769 bp, Homo sapiens
  Payload ID: 17650
  Gene Name: tetratricopeptide repeat domain 39A
  ENST ID: ENST00000380849
  CDS Start-End: 205-769
caactttctcacggagctgtagtcacagacacgttcagagcagccttccccacctgcctcgtggcgttcactcctgtggggtgggccctgttactctcatccccattacagatgaggaaactgagacacagcacttaagtgacttgtcatcggtcacccaggaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacc

SEQ ID NO: 190593 - DNA, 547 bp, Homo sapiens
  Payload ID: 17650
  Gene Name: tetratricopeptide repeat domain 39A
  ENST ID: ENST00000401051
  CDS Start-End: 74-547
actgtagcctccacggccgccgccgccgccgcgaggggccgcccgcggccccgtccgagcccggcccgcgcccatggcctttctgaccacctggaaggaggcggcctccgggaaaagcgaccgcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttg

SEQ ID NO: 190594 - DNA, 850 bp, Homo sapiens
  Payload ID: 17650
  Gene Name: tetratricopeptide repeat domain 39A
  ENST ID: ENST00000422925
  CDS Start-End: 169-850
ccccagtctgggggaggttaccgcagacagcctcatcccagttaagcagaagaggtgccggggctgccgagggaaggactgtgcctgtctgcactgactgtccatccggcctggatctttctctccaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcg

SEQ ID NO: 190595 - DNA, 2790 bp, Homo sapiens
  Payload ID: 17650
  Gene Name: tetratricopeptide repeat domain 39A
  Uniprot ID: Q5SRH9
  ENST ID: ENST00000447632
  CDS Start-End: 50-1891
gtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccagagccttgcatgatccctctcacgcctgcagctgcccacctgggccaggccgtcagcatcttttcctcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 190596 - DNA, 978 bp, Homo sapiens
  Payload ID: 17650
  Gene Name: tetratricopeptide repeat domain 39A
  ENST ID: ENST00000439482
  CDS Start-End: 88-978
gcacagcgcccggctcggggttgcggcggcagcacctgggccgcgattggcgtccggctggggcagcgccgcccgcgcccctcggcgatgacctcggctggcggcgccccaggagccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgca

SEQ ID NO: 190597 - DNA, 2718 bp, Homo sapiens
  Payload ID: 17650
  Gene Name: tetratricopeptide repeat domain 39A
  Uniprot ID: Q5SRH9
  ENST ID: ENST00000413473
  CDS Start-End: 74-1819
actgtagcctccacggccgccgccgccgccgcgaggggccgcccgcggccccgtccgagcccggcccgcgcccatggcctttctgaccacctggaaggaggcggcctccgggaaaagcgaccgcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 190598 - DNA, 931 bp, Homo sapiens
  Payload ID: 17650
  Gene Name: tetratricopeptide repeat domain 39A
  ENST ID: ENST00000411642
  CDS Start-End: 93-931
tctttgtctgcacgaatgcccccattaatgcgggaggatggtgacggctcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtga

SEQ ID NO: 190599 - DNA, 1780 bp, Homo sapiens
  Payload ID: 17650
  Gene Name: tetratricopeptide repeat domain 39A
  Uniprot ID: Q5SRH9
  ENST ID: ENST00000530004
  CDS Start-End: 216-881
catggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttga

SEQ ID NO: 190600 - DNA, 577 bp, Homo sapiens
  Payload ID: 17650
  Gene Name: tetratricopeptide repeat domain 39A
  ENST ID: ENST00000527205
  CDS Start-End: 74-577
actgtagcctccacggccgccgccgccgccgcgaggggccgcccgcggccccgtccgagcccggcccgcgcccatggcctttctgaccacctggaaggaggcggcctccgggaaaagcgaccgcaggaccttccctgcctgggagaatccagttgtgcatcgtcctgtgggcaccagggagccttcggggtctcccgtgactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctg

SEQ ID NO: 190601 - DNA, 519 bp, Homo sapiens
  Payload ID: 17650
  Gene Name: tetratricopeptide repeat domain 39A
  ENST ID: ENST00000532836
  CDS Start-End: 146-519
cagacagcctcatcccagttaagcagaagaggtgccggggctgccgagggaaggactgtgcctgtctgcactgactgtccatccggcctggatctttctctccaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcagggttcctcacacggaggggcagtcaggcccag

SEQ ID NO: 190602 - DNA, 429 bp, Homo sapiens
  Payload ID: 17650
  Gene Name: tetratricopeptide repeat domain 39A
  ENST ID: ENST00000525906
  CDS Start-End: 92-429
atttagtgggcaaggtgctggggttgactcccggctctgccccagtagctctggggtcccaggaagcagaggtggggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtg

SEQ ID NO: 190603 - DNA, 3053 bp, Homo sapiens
  Payload ID: 17651
  Gene Name: tetratricopeptide repeat domain 39B
  Uniprot ID: Q5VTQ0
  ENST ID: ENST00000297615
  CDS Start-End: 38-1879
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaacc

SEQ ID NO: 190604 - DNA, 3221 bp, Homo sapiens
  Payload ID: 17651
  Gene Name: tetratricopeptide repeat domain 39B
  Uniprot ID: Q5VTQ0
  ENST ID: ENST00000380850
  CDS Start-End: 38-2047
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatgtacgctcagtatttcaaagtgcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaacc

SEQ ID NO: 190605 - DNA, 10483 bp, Homo sapiens
  Payload ID: 17651
  Gene Name: tetratricopeptide repeat domain 39B
  Uniprot ID: Q5VTQ0
  ENST ID: ENST00000512701
  CDS Start-End: 38-2086
aagtggcccggccagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgagttgatgaatctgggccttatttctatttccattttgaagaataacttgtcatagaagcctctgcagtttaacagaaggagccacatattgggagtcacgagttcatctctgtgggttaatagttccatgacacggagtacgtagctcagcttttcaggggttcagttgccccactatggatagcggtgtggtatttggtacttgtgagggctcaattagataaaacatatgatagctttttgtaaactgtaaaaggctatacaaaagtatgaattattataataattatggttttttatgtctggattacagtatcaacacaaaagtattggctgatactgtggtttgtgttgtaaaatgaaagaagtgtagaaattcaaataccttactgtgtattcatgtgtttgatgttgacagtaggctacccaggttatatgaacctgctcctgccgttccctgccacatggacctgtatcaagcagtgtgtggcttgttttcttcaaggtactgattcttgaccaacactgaggatgtatatccaatgaaagatagatatcaatggcggtagatatcaatgtgttattagtaatacaactttaggtacagacaaaatagaaaataaaattaactgtcattataattagtagtggaaaatacattaaaaattatttgtgtatagctttggaaaaaagttttccaaaaaaagctttttggaaaaaagctcttagaagagctttggtaacattatttttgaaagcgcacactcacattgtgactgtgggtatactgagcatatattcttacattgttactgtgagaagctgcaagtcagtgctgcaagtcagtaacaaattctcttttggggataaaatgaaacagttttaagcttagagtggccatttttattttaactctgcattactaaacaaatataaaagaaattcatctccatttaaaaatcttttttgttatttatattttgttttatttttgtttcctattctttatgcagttacctgatactatggacagtatatccagtggatcttttagtactgtaatatcaaaatgctacaaatatttatgtttcctgctatgttcaagatattgtagtggcaccaacttcttgggcatcagctaatattgcattttggagtcattagggtgttctgtgaagaatgaatactgaagtgacagttttatctagttttttgaggggcatttatgatggggttgggttgccattgtgtctgacagtgcaattcatgtagttcctggcataattgccttttttttttccttaatggagaggcagggttctgattggtgctgtataaatttaagtaactttgtgctttgtaggaatggtgacaaggaaggcatgatttccccctgacaaggaatgaaaggtgaactgtatcagctcttatctggacatatatgttaatgttttctatgctccctgatacaagaagtttccaagttatataggaaaattaagtccattgatcctgtctttatcctcagagggcagaaatgagacaagtggataaaggctgtaggaagctgaattccagattaatcagtgccgaggaagatttttcattatcggaaaacccaacagtctaaaatcaataaccagttcttctgcaaaggggtgagtttaagcagggctaatgtgactgtcatttctgcctgtcctgcaagcttagactagttgaactttgaggtcactctatgattcttttattagggcttcaaatcagcagggagtgtgtaaagaaaaaatgctccccccctaccatttcaaataaaagtgaatgttttctctttcaaagctactattagaggtagttgtgatagacactaacaatccccggtgttaatactttccactccttttattttattttaatttaatattattttattgagacagagtctcgctctgtcacccaggctggagtgcagtggcgtaatctctgctcactgcaagctcctcctcccaggttcacgccattctcctgcctcagcctcccgagtagctgggactacaggcgcccgccaccacgcctggctaattttttgtattttgagtagagacggggtttcaccgtgttagccaggatggtctcgatctcctgaactcgtgatccactcctttttaaagtgagtctagtctgttgatcttcataaataggagggttttcctccagcttggacattaaaaataatttttaaaaagatctttgtggctaactggaaaatcttctggaattatctaatgcttcattcatttccctccatttctgttttttttttttgtatttatactctgcatatttagaaatcttaaattcaaatacatttagttaaaatgagttgacgaagactccagtgatgttttaataccctaagattttgtgattccttgggcctggaatggatcttagaaaattaccttgccctcatgagcctgtaaaccgtgttgtttcccctcagtcttgctctgtccagtacagtagcccctcgccacacatggctgcggagcacccggaatggcttacagcacatgtgggaatggtgctgaatgctgaggaagcattcactcatacgtgctgcacttcttaaaggcctcccaatagcctgctttgcggagttctggcttttacttgctgtctactatgatcacctgatttgtgcttcacatacatatctgtgaagtttgctttttctatttaaagtgcccttaaactttcatttgatcgtgtttatctgcagatggtcagtgtcattggcatatttgaacattattctgccctccctccgccaaactccttatgtactagattaagaaattttatttttgagatgatgattttaatttgattttacagacattcttttttacaaagtacagttgttagagttatagaagagtgattcacatctttgagaagatagatttcatgattaatatatatattttttgagacagagtttcgctcttgttgcccaggctggagtgcaattgcacgatctaggctcactgcaacctctgcctcccaggttcaagcaattctcctgcctcagcctcccaagtagctgggattacaggcatgtgccaccatgcccagctaattttgtatttttagtagagatggggtttctccatgttggtcagtctggtctcgaactcccaacttcaggtgatctggccgccttggcctcccaaagtgctgggattacaggcgtgagccaccatgcctggcccaatattttctaagataaaattattctgagaaatctagtggaatcttttccattgctttgttattaatgtttcaacactgactttctcaactaggccagtattactatttaaaggtttttagaggctggcaatggtggctcacgcctgtaatcctaaaactttgggaagccaaagttggggggcgtcacttgggaccaggggtttgaggccagcctgggcaatacagtgagaacctgtctttacaaaaaaaaaaaaaaaaaaaaaaatgagccgtgcatggtggagtgcacttgtagtcctagctactagggagacttaggtgggataattgcttgatcccaggagtttgaggctacagtgagctaagatcatgccactgcactccaccccaggtgacagagtgagaccctgtctcaaaaaaaaaaaaaaaaaaaaaaaaaatatatatatatatatatatatatatatatatatatatatatatataaaataaaggtttgtggacacatgttacccatttagagaataatttatttttgaatgtgtatgatacctaagtgatatgcatatatataattaagacattttaaatctcttcagatatttcttcataagatacatgtatctatagatagctatatacaaaactacttacaaataataaatagacattgttttatacagttctttccaaagaaatgcaggatttcttatcctagtccttcctccccgagtccagttatttacatatttttgtctttaagtgttagattgcttgtttctgctgcctattgttggtagttttgtcttttacacatttgctgttagatttagttattttgaaatgttgaacttgaaatgtaatgaaaaggacacatcagaatttatcatcagggaagatatcttttatgttgagcagctgctatctgatcttgacagactgtcctcttagaggactgttgaagtccattctagtcattttgtaacttcataactgcagaaagaaatgatgcaaggactgtttagtggactgagatggctgagcaggttcttggcctgaattatccagaggagataggtggatctagcttcagaggaagtctacaccccattcccttctgcttacaatgtacccatgatatgtgtttagcacagtaatactgtaacaggacatcacatggaaaaatcaaagcagctggctcactgtatttaactgaaaagaatgcctacagattggatatttaatagggaaaattaaggcactttaataacaaacttcattatgtgaaacttgttgaatattaacatacaatataccttgtatattaatgccatagtttttagaaacactaatttaaacaacaaatttaaggggtgctggcatatcccagtgacaccttcagttttattgctgcttagtattttctagtaaattagttttaattattggtagtctgttgggcaccatttgggaaagaaataaattggtctcagtgtagcagacttgtagccaaaaactttgaataaaaaataagtataataaagaatattatttcatttttaaaggaattgtattattttgaagtgctgtgtggttgatatggtttggttgtgtctctacccaaatctcttattgaattgtagttcccataatccccacatgggagggacccagtgggaggtgactgaatcatgggggcagttttccccatgctattctcatgatagtgattgagttctcacgagatttgatggttttataaggggcttttccccctttgctcagcacttctctttcctgccgccctgtgaagaagaaggtgcctttctttccctttgccttccgccattattctaagtttcctgaggccttctcagccatgcagaattgtgagtcaattatacctcttttttaaataaattatccagtctcagatatttcttcatagcagtgtgagaatggactaatacaatggtcttaatcaatttgaaggtatgacactctttgctttggaaatcatgtagacattttaagtcattcctatttttaatgtagacaaacgtccaggtagcaattttggggataataaatgagttcaccctttttttttctttttttccctgagacagagtttgctcttgttgcccaggctggagtttaatggcacgatcttggcttaccacaacctctgcctcctgggttcaagcaattctcctgcctcaggctcccaagtagctgggattacaggcatgtgccatcacacccggctaatttttgtatttttagtagagacagggtatctccatgttggtcaggctggtctcgaactcctgacctcaggtgatccgcccacttcagcctcccaaagtgctgggattacaggcgtgagccatcatgcctggccgagttcagcttttattcacattttttccccaaagtgatttattcttcaaagtagacagttatgttctatagagtgttttgttttttctttaagaaaataatttacataaacagagattatggtaaacattttaaatcttaggctgttggttaaatttaatggtttaagcactgttgggttctctttaattaatatttgcagaaggagaacatatgtgtttcactgatatgtatggtccagaaaaattacttaattctcaaaaatatgttgcattctcatattgtgttagggaaaattccataagtagtctatttttttttttcttttgctgactgttaacatccaaacacctgaatgaaaactgactcatttctgtattggtgtttaaaaatattgatttgcagatgttcacagaacacttgcattttttgattcacattgctaaatcaaatgtaaaggcaaatatgtatatttaataaatgagaagtatttttttattactgaaatttattctcaaagcaaatgtattttgtagatgtttcatttgggagattttgctttgccttaaaacatacaaaataaacctgtcttgtggtctgcccacctcaaaacctctgttaacttgacatgtagaaggagttcagaattctttgataatgtgtggttttcacttttgtttggattaaacaaaaataaaattagagtccatagcactttgtaaactaatgtgaagtttcttgttgaatcataaaagctacctgtatgtactttataatttaatgttctgttagtaaaaattgtcagcattttatctttttctcttctcattacattttagtctccaatctttcccactctcagcagtcacagttttgcagagcaaaacatttttagaaactgaatatgtgtgagttctatataaaatgaatgtgttagtaacatccatctgctgatcaaggaggcattggatctggtactagaaggtgaaattgattgtagctatcaaagcattttatcaatgtaagtcaagaaaaaagaagaaaactgtgaacctctgatatttttaacataaaaactgttcccaatgagtgttctcttgctgattttgtgttaatgttattgtctatgatttttaagctaatgctaatataaaatctaaaatttcaacatgatgacaacaattcctgtagcctgtttttaccattaggatgtttttgaaaacagatgtcatcttagaaattatatttttaagtgcaaataaatcatcctgacttgaaagtcaacacattttatttttcattccgtagtatcacagaatatgctgcatttagatacaggtttaatttgccagattttctcaaaattctgtatttttatattgctacaactggtttacttaacatgcaattgaattgttatttaaataaattacatttgatggaa

SEQ ID NO: 190606 - DNA, 1950 bp, Homo sapiens
  Payload ID: 17651
  Gene Name: tetratricopeptide repeat domain 39B
  Uniprot ID: Q5VTQ0
  ENST ID: ENST00000507993
  CDS Start-End: 324-1877
actttgcttgtgcctgagaattgagagtctcactggagaccaaggaataaaatagaaattgaggatttttgttggctctaaaattgaggtttgtctcttcttttagttggcttaaaaaaaaatctggtagaagagagggaaagacatcttcatagtgggactatattcattcctccaaagttacagctgctctaaatctttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagt

SEQ ID NO: 190607 - DNA, 2243 bp, Homo sapiens
  Payload ID: 17651
  Gene Name: tetratricopeptide repeat domain 39B
  Uniprot ID: Q5VTQ0
  ENST ID: ENST00000507285
  CDS Start-End: 600-2153
atgttggtttcttctcatctagagaggctactgctttttctttttgaatttattttcatttagatgggcgtcccccccacctcccgtttccacctcttctaggggtgtaactatagcgttagtatgttgggtagggtcttttgggttcgcttctaaggccctgcgcgattctgtctgcaggttttatattggtctgtgcagtttgacctggagatcttctcactcagatatggcaacaagcagccttcactttgcatcatgtgatacacaacaggcgcccagacagcgcggagcgtctactgtcagcagagagccataacaaaagagaagagaatggaggaaggaaccttttgggaacacagaacattgaagcatggctgagacagtgaccgttcaaacaagagctacatagatgtgtgagagaggaagactacaagttggtggccacaggacaggcaagggacttgggggaaggttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtg

SEQ ID NO: 190608 - DNA, 900 bp, Homo sapiens
  Payload ID: 17651
  Gene Name: tetratricopeptide repeat domain 39B
  ENST ID: ENST00000506891
  CDS Start-End: 1-210
gctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatttggcttaaaaaaaaatctggtagaagagagggaaagacatcttcatagtgggactatattcattcctccaaagttacagctgctctaaatctgtgagtgctgaaattgaagaaaatagtgtgacttgctgcggaggaggatctggtcttcccgggatgccatggctggtttattgctgctgcaaggtgtgcgtctgggcggctgagactcctgctgcagaacaatggcaggatgatgctggttcactttgtatttactgtttgtcttatgtcctctgctggtttcattatagcattttgttttgttttgttagggtaattagaaccttagagattagtaaagtggcttgtcctcagaaatagcatgtgttgattgtcctagactctcacctctgaccttgctgtgctggctttagtggtctctttgtagcagattacagtaaatgtgagctaccaaaaagtgacctttgtatggccaccttttaaaattgtgcatcagaatcaatgctgggtattttttttgtgtgtgtgacgcagaccctggagtctaaacatctgtccttagtcatcgtgtcccattttccccctttggaatttcctggacgttagaattgtatccttgctgaattagtgagtgagttttgagcattctctaaagataagttaatttttgattctcaccataacccccatatgttcctgatttgtctttgttgaataaaagtcatattattgaaca

SEQ ID NO: 190609 - DNA, 2304 bp, Homo sapiens
  Payload ID: 17652
  Gene Name: tetratricopeptide repeat domain 39C
  Uniprot ID: Q8N584
  ENST ID: ENST00000304621
  CDS Start-End: 283-1851
aatcatgcttacgcatataggttaaccacagttatgtaagcaggttctgagaaaaggtgagaaagagaatggagagttttgctacaacagaggcaggattctgaatttatttccagctgcccatcttgtccctcctggagacctaacccctccagcacctacacacacagcctctttagaagcaactatcctgccactggctcagaaaggctgagtcctaagaattctaaaatcttgctcctaagaaatctcaagcttcttttgtgaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgtttt

SEQ ID NO: 190610 - DNA, 2442 bp, Homo sapiens
  Payload ID: 17652
  Gene Name: tetratricopeptide repeat domain 39C
  Uniprot ID: Q8N584
  ENST ID: ENST00000317571
  CDS Start-End: 237-1988
tgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcagcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaatcatagcccactaatgagttttggagccagctttgtcagttttttgaatgccatgatgacatttgaggaagaaaaaatgcagttggcatgtgatgacttaaaaaccacagaaaaactgtgtgaaagtgaagaggctggagtaattgaaacaatcaagaataaaattaagaagaacgttgatgtccgaaaatccgccccctctatggttgatcggcttcagaggcagataatcatagctgactgccaggtttacctggctgtgctttcatttgtaaaacaagaattgtcagcttatatcaaaggtgggtggatccttaggaaagcctggaagatttacaataaatgctatctggacatcaatgcccttcaggagctgtatcagaagaagctaactgaagagtccttgacttctgatgctgcaaatgataatcacattgtggctgaaggggtgtctgaggagtctctgaacagactgaaaggtgctgttagctttggatatggcctttttcacctttgcatatccatggtgcccccaaacctgctcaaaatcatcaacctgctgggttttcctggagaccgcctacaggggctttcttcactgatgtatgcaagcgaaagtaaggacatgaaggcccctttagctacattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgtttta

SEQ ID NO: 190611 - DNA, 4117 bp, Homo sapiens
  Payload ID: 17652
  Gene Name: tetratricopeptide repeat domain 39C
  ENST ID: ENST00000540918
  CDS Start-End: 251-1081
gtgctgaggagaggagcccaggtctgcgggtgggggacccgtcctctgagaagcctgcagcttctcctccaggacccttccagcccacctggctggctgtggggataatgggcacttgggagcattggagggggaggaagcatagagaaagcagcaggagacgcacctggaagcccaggggagggaagtccacctccctgcaagtgtagggcagtgagaggagccctggcaccagcagagcaagaaagaaatgcatgcaccgttcagaataagctgtcaggtcgtctggctgtttaagatttatttattaatgtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtgaaaaaggcagagcgatttcggaagcaaaccccaaccaaagcgctctgtgtgttggcgtctattgaagtgttgtacttgtggaaagctcttccaaactgttccttccccaacctgcagaggatgagtcaagcttgccatgaagtggatgactcatctgttgttggattaaagtatttgcttcttggtgccatacacaaatgtctaggaaactcagaagatgctgttcagtacttccagcgagctgttaaagatgaattgtgtcgtcagaataacttatatgttcagccgtatgcctgttatgaacttggctgtcttctattagacaaaccagagactgtaggaagaggcagagctctacttcttcaagcaaaggaggatttctctggctacgactttgaaaacagattgcatgtccgcatccatgctgctctggcctctctgagggaattggttcctcagtgacagacccggaacacccgctccgtccctccccacccagggtccgcactttaaaataaaagcagaggacaaagctcttgtgaagatgggcttttcttctgaaaaccacctgtgccagggacacattttcccagttaagctgacatattaaagatctcctcttttaaacatgtagctgaaaagtaataatgatgttgaggaggatgatgatggtaataataactaaccacctggggagagggttaagtgaccttgctcaaacgttttagttttgtgatttattatttttaaaataaaatcaaacggaacatccaacccaagatcctgtaggaacacctaccttaagcacatatctgaatgggtaacatgatgaggtacctgtaaaattattaacaatatcatgacatagcatttatatttgtgttttgaaaaaataaaagtgctttctagtgttttactttatcctcaaaatactccagtgaataacatagcacagatattcttaaccccactttgcagacagtgaaactcaggcacaaaaaggcaaattgacttatcccaattaattattcctgttatcagcagagcaatgaatagaaagcagatctcctgaccaccaactgacttttattgtaaaaataattcatgttaataggccagaattccatgttttacttattaaaagaacaaaatcttcagctgaagttatgtcaccagaaatagtcatctccagattgtctacagaatgtttcaaagcgatggacactctttttcctttgaaagccaaccaagtaagagcaaatattaatagaagataattttacaactaaaagtgtgactcttttgctaatctattagcctagtctatagattagacaaacagtatctacattttaggagtttacctttctttgtgaaaattgtcaaattaccaacttttggaaatcttttgacacattacttgaaaaggttattcgtgaatgaacatagattttggcctcaaaatatttgctggtggaacatttgctgggctacacagtgccaggatttaatcattttccccttagctcaggttatttagatattatacaaggaattcaaagttatttttttattcttcattgctaatttttgtcatttaatttacctccatgcccggtactgcaaacctgtggttttgaagaatctaaatacctcagtcacttttaagaatctctgccataatttggctcaatgtttaaggttagatttttaaagaaatttttattgagctaaaggatatcattttagggtatcgtttatttacaaattcttttggctgaaacatgatctcatattaatattttaatatttcttttcaaaataaaacagaaaagcaagtagaatgttggcaaattttatctgatttgaccttgttttgagggaatagtcataatttctttgaaagaagttatttctcactgattttggctaaacagtattcatatttcttcatctctgttactgaccacttttcagtagactgtttccaaaatgtgtattcacattgactttctccctgatgtgaattccgtgtgggttttagataatagtaagagagaagagattgctctcctatattcagtgaatgagaagggaacttttttctgaagagcaaaattggtgcccaaaaatattggacatctgttttttgtttttttttttttttttttttttttttgagacggagtctcgctctgtcacccaggctggagtgcagtggcgtgatcttggctcactgcaacctctgcctcctgggttcacaccattctcctgcctcagcctcccaagtagctgggactacaggcacccgcaaccacacccggctaattttttttgtatttttagtagagatggggtttcaccatgttagccaggattgtctccatctcctgacctcgtgatccacccgccttggcctcccaaagagctgggattactggtgtgagccaccgtgcccggcctggacatctggttttaactagatggaagggaagaacattatgaatctttaaaatacggctgttgccatttttctctcttcttaacatgcagcataggtgacaagcttttctgtcatcatcatggagcattctgaatcatgacatttttgtttgagagttcattcttgaattttcagttcaaaatattgtttgaactattattccacattcaaagattatataaggtcctgtgcttttgaatctttttcaaaacatttatttctgcctgcttaaaaaaaatacttttatttccccacagagagttcaggacttcagattagtttgtgttcagctcacttaactggatagacaattttgcgttttgcaacaccatcctgtaggttttctttactagtcaaagtgtaggtctttttaaaatttttaatctttatttttatttttattttgaaacagagtctcactctgttgcccaggctggagtgcagtggtgtgatctgtgctcactgcaacctctgtcacccgggtttaagcgattcttctgcctgagcctcccaagtagctgggattacaagttcctgccaccgtgcctggctaatttttgcagttttagtagaggcagggttccaccaccttggccaggctggtcttgaactcctgacctcatgatccacccaccttgtcctctcaaaatgcttacaggcatgaaccactgtgaccggccaggtctttttttttttaaagagtctatcctaggcttggtacagatggcgcctgtggtaaatctgtgttaacatggtggtagaccatggagaatgggtagatggagcttctagactccaaaacaacaaaaccacagtgtgagtacactgtcccattaggttgactgaagtctgagtacattttctggcctgcgtgccgtgacttatccaacctgtgaactgattgtgatctgcttggtaacttggtttggtgtaaactgctcttaaccctttgctgatgaagaaaataatcatataagtggaactatttgcatcta

SEQ ID NO: 190612 - DNA, 389 bp, Homo sapiens
  Payload ID: 17652
  Gene Name: tetratricopeptide repeat domain 39C
  ENST ID: ENST00000579214
  CDS Start-End: 189-389
gagcccttaacacctgagcaaaggagagaacgctggaggagaaggcggcgcgagctgagcccttaccacctgagcaaggagagtgtcaaatcaacagtgccttgacatctttccacactgctttggaacttgcagtagaccagagagaaattcaacatgtctgtctgtatgaaattggttggtgcagcatgatagagctcaatttcaaggatgcatttgattcctttgagaggctaaaaaatgagtccaggtggtcccagtgctattatgcctacttgactgcagtttgtcagggagccactggtgatgtggatggggcacagattgtctttaaagaagttcagaaactcttcaaaaggaaaaacaatcagattgaacagttctcggtg

SEQ ID NO: 190613 - DNA, 533 bp, Homo sapiens
  Payload ID: 17652
  Gene Name: tetratricopeptide repeat domain 39C
  ENST ID: ENST00000577185
  CDS Start-End: 40-171
atctaagaaattttatgcactgttaatagaaggcagtatatgagtggttggaaaactctctcccagcaacagcagagagatgccccttcaaagatacttctctgtggaaaaagttttttgacttctgagaaaacctcagcgcttcctggagaaactcaaaggcgcttgtaagagatgttgagtcagcaggcctctgagcctcttctctgcctaaaaccatgtcagattcttgggaggactggaaggacttgcaggctgtccatgatttctagacaagtcatctgctcacagacaagaatgtgtctctgccttgctcctggagacgataggagagtccacagatgcagagatgtaagaaaaggagaagaaatgaaaagcagaaatggtttaagggaactggcgggaaagacaggaaactcatctgttgactttttccatcctcttcaactcagtggtgtgttggaaaaaggcatcttttttcccccaactattacactgtctgaaaaggtcctaattaaatattcattaaagat

SEQ ID NO: 190614 - DNA, 1048 bp, Homo sapiens
  Payload ID: 17652
  Gene Name: tetratricopeptide repeat domain 39C
  Uniprot ID: Q8N584
  ENST ID: ENST00000584250
  CDS Start-End: 453-683
gtctcgcgtgcgtgtgtccgagcagtcctgggcggtgggcgaaggcgcggcttggggacccgggaggggccggggcgcgggggctgcaggaagtggaggcggccgccgctcggggaccggcttggcggggtgagagacacccggaaacggattccgcttcggggcccgcgcgagttgggtgcttcggagggcgcgagaggagcgggcgggtgctgctgagtaatccccgcggcggcggccggacgcccacctcccacgccgcgccgcagccgggccgcggctcctccctccgcggtccttccctcctcttccctcccgtcttctcccctcccctcccctcccctcccggctccgcttggctccgggcaggtagagccgggctccgggcgcgcgcggggccgcagcagctgctcccgatctcgcctcggcccagcgcagggcctcgcacgcccatggccggctcggagcagcagcggccgcggcggcgggacgacggagactcggacgcggcagcggcggcggcggcgcccctgcaggacgcggagctggccctggccggcatcaacatgctgctcaacaacggcttcagggagtcggaccagcttttcaaacaatacagaaaaagttttttgacttctgagaaaacctcagcgcttcctggagaaactcaaaggcgcttgtaagagatgttgagtcagcaggcctctgagcctcttctctgcctaaaaccatgtcagattcttgggaggactggaaggacttgcaggctgtccatgatttctagacaagtcatctgctcacagacaagaatgtgtctctgccttgctcctggagacgataggagagtccacagatgcagagatgtaagaaaaggagaagaaatgaaaagcagaaatggtttaagggaactggcgggaaagacaggaaactcatctgttgactttttccatcctcttcaactcagtggtgtgttggaaaaaggcatcttttttcccccaactattacactgtctgaaaaggtcctaattaaatattcattaaagattca

SEQ ID NO: 190615 - DNA, 2395 bp, Homo sapiens
  Payload ID: 17653
  Gene Name: tetratricopeptide repeat domain 4
  Uniprot ID: O95801
  ENST ID: ENST00000371281
  CDS Start-End: 88-1251
aggattgagggaagggaacccgcgccgccggaaggagccgctcgcttcacggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgtcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactgaaggcttaaagaagaaatgtgcagatcctgatttgaatgctgtcctttataccaaccgggcagcagcacagtactatctgggcaattttcgttctgctctcaatgatgtgacagctgccagaaagctaaaaccctgccacctcaaagcaataataagaggtgccttatgccatctggaactgaaacactttgccgaggccgtgaactggtgtgatgagggactgcaaatagatgccaaagagaagaagcttctggaaatgagggctaaagcagacaagctgaagcgaattgaacagagggatgtgaggaaagccaacttgaaagaaaagaaggagaggaatcagaatgaggctttactccaggccatcaaggctaggaatatcaggctctcagaagctgcctgtgaggatgaagattcagcctcagaaggtctaggtgagcttttcctggatggactcagcactgagaacccccatggagccaggctgagtctagatggccagggcaggctgagctggcctgtgctctttctgtacccagagtatgcccagtcggacttcatctctgcttttcatgaggactccaggtttattgatcatctaatggtgatgtttggtgaaacaccctcttgggacctagagcaaaaatattgccctgataatttggaggtctactttgaggatgaggacagggcagaactataccgggtgcctgccaagagcaccttgctacaggttctacagcaccagaggtactttgtaaaagccctgacaccagcatttttggtctgtgtaggatcctctcctttttgcaagaattttctccgggggagaaaggtgtaccagatacgatgactaagccagggcccctggatctcctcccttaccctcctctgctgggaacctagcacacctgaatcagctggacatactgctggagtccagtgctttctttccgtcaccctggggatagtccttcctggcatcgtggtgggggaggagcctctggcttccctaaactgcagcctctctggctggtcttcactttcctcagttgatataaaactctgggtcttggccatgatgtccttggactccatcgctaaagggaccatctgctgcagttaccacagcaactgacctgagcggcaccctggtctgtggagatggactcaggatccagtgacatgattctgaacttttgtggagtttgacaccttagagaagctacccctcaaactgcacatctacacacaaacaaacaatgcataggattccaaggctttaaagctgagagaccctggcctcaagttatttcatgcgcacagagggaagccatgtggggttgctgaagatgccttgaggtgaaatgggggcaggaaagccacatcttgctctgcatttataaagaccgtacaaactcagatccttggtacccctaaaaagattgccaattttcttcatctttgccatatggaggactgtgacagactttggacagtggcctcttgagttcctctgcagttttgacatttaggattttgtgtcttttaaactggaaaatcttctagcatgttgggttgttacagagtatatttttgtctgcagctgtttgttgccccattcctaagaggagtttatccatcctgacttgtagctgtgtgacttcttgcagtgcccccaccccatccccccgggagagtgtacttccctgctcccaatgcagagggatatgcacaggcatgagctgtcctgcgtctgacagaagcctgaagagtcatgtgtggttggcctgtgctcttccctctgctgtgagaacacatttcccacagaggagccgttccatggagccgagctacagcagctggcctgcagccactgagtgtcacagcaatgagagagcaatgtttgctgtagtaagcagtgagatttaggggttggttgttactatagcagagctaatacatgagtaaactgaagccagctgctgtccttaaaa

SEQ ID NO: 190616 - DNA, 4779 bp, Homo sapiens
  Payload ID: 17654
  Gene Name: tetratricopeptide repeat domain 5
  Uniprot ID: Q8N0Z6
  ENST ID: ENST00000258821
  CDS Start-End: 58-1380
ggtgagagagggcgtgcgtctctgtggttataaagttgggggtggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcagaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcttctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaaaaaaaaaacaccacgtagtttggcctgctttattctccctaggcctgtattctttgttttaggatcacttcaatttattggagtaatacccccatttttttctttatacaaagcagtttatttctctcccagttaaaagaattccgacaatagacagccccaggcaggaatggcaactccacaaagttgctagagaccagctttcttccattttcccattctgtcattccctaggggtggtcttcactatggtccaagatgacagagcaatactgttctaatagtgttactaggctgaaggaccagagagagttagataaatcctcagtttctttagagtctagtgacatgttttataacagtttatcttaatatccttgtggtaaaatggagaaatgtgagtgaggattaataaccaattgaattggcctggcacggtggctcagcctgtaatcccaccactttgggagtccaaggcgggtggatcacgaggtcaggagttcaagatcagcctggccaagatggtgaaactccgtctctactaaaaatacaaaaattagctgggcgtggtggcaggcacctgtaatcacagctactggggaggctgaggcagagaattgcttgaacctgggaagtggaggttgcagtgagccgatatcatgccactgcactccagcatgggcgacagagcgagactccgtctcaaacagcaacaacaactgaatggctgtaatacattaatgtatacagatgaattgagaagtcttctagtgaaatggctcagatctttgttcttggtccagtcctgttcagtttttgatcagtgccttgaatatcattgatgactcattaaatttataaagagtgcagaggcctcctcagagaatggatggtagaaatgcattgatgagagaagttttatctatctatctgtctatctatctatctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccaggtgactctgatgcacagtaaaatttgagaaccactgtttaagagtattgacatagaatggaattgctggatcatagagtatatacatgttcaacttttttgagaagcactaaacatttccaaagtgcttatattagtttatgtctctactatcaatagatgagtcaccccaatgctccccatcctcttctgtgcttggtattatcttttaggtattgcaaatacaggagatttgagtattatttccttgtggccttaatttgcatttctgattattaatgagcttgagcatcttttcatatatttagaagccactaatattttctctcggtaaaatgcctattcgagtctttgcacactgctgtattggatgtcaaattgatttatatattccctgtactaatcgtttgtctacatacagttttatcctgtttttttttttattctattgggtcttttgctgaacagaagttcttaatttcaatgtcattgaatttatccatcttttatgataatgctttttgtgttttaagaggttcttagctctcctaaagtcataaggacattttccctctactgctttatgaagttattttgtccttttcttacagtatgactttattttatgttatgtacggatataatttttttcataatgagtaaatagcccagcaccttttattaaagaatcaatcctttccctactgatctttaaagcccagtctgtctttttctttttttgaaattgtctagctttttaatttttaccaaccagatgattataaaatatcacatagtaggcataaattacatttctttgtccattcctgtttctttttctatgaaatctctgttttcttttgtccaatttttattgggttgtcttcttattgattccttacatgttctggatactaatccattataaattatgtttttcaaatatatttatccaaatcgc

SEQ ID NO: 190617 - DNA, 1755 bp, Homo sapiens
  Payload ID: 17654
  Gene Name: tetratricopeptide repeat domain 5
  ENST ID: ENST00000383029
  CDS Start-End: 5-391
ggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcagaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctggtgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcttctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaaaaaaaaaa

SEQ ID NO: 190618 - DNA, 748 bp, Homo sapiens
  Payload ID: 17654
  Gene Name: tetratricopeptide repeat domain 5
  ENST ID: ENST00000553828
  CDS Start-End: 702-748
gttgggggtggagtggccgggagatgatggctgatgaagaggaagaagtcaagccgatcttgcagaaattgcaggtggggccgtagattaaattctgtatgtgtttttgttactccgaatgaagcagggagtccagtttatgtactgcccgtgaattcctcggcacacacgcgaagctgcgtgcgtctgtgtggttactataacaaccctcgagggtgcagccgcagccagccagggagcctcgttggaacctcctgctgccgacctgactgcggttaatttcagtcctgtatggaagaagatttgttgctcctaactgttcatgtacatttttagagaggacgttgttttctcgattcatccatagcgaatagcatatacatgtgtgtggcagatctgcatgaactactgtcacatgttgttttgatccctacaaaagccatttaacacctttctgctttgaatttggcaacaatcacgctaatgacctgcactgcaagtgtcctggttactccccttaggatttcagttttgatttctttcaacctgtgtaattccactttggggtctgatgcagaggggtccagactccacatagtccacaggaactcgtggatcagctctactcatttcgagactgctatttcgagacacatagtgttgaggatgctgggaggaagcaacaggatgtgcagaaggagatggagaaaaccctacagcagatggaagaagtagtgggttctgtcca

SEQ ID NO: 190619 - DNA, 1681 bp, Homo sapiens
  Payload ID: 17655
  Gene Name: tetratricopeptide repeat domain 6
  Uniprot ID: Q86TZ1
  ENST ID: ENST00000267368
  CDS Start-End: 62-1624
tgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatgacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaa

SEQ ID NO: 190620 - DNA, 1972 bp, Homo sapiens
  Payload ID: 17655
  Gene Name: tetratricopeptide repeat domain 6
  ENST ID: ENST00000382320
  CDS Start-End: 113-1915
tgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatggcttttgattcttttacaaaagctgtgaaagcaaatccagattttgcagaaagcttttatcagcgagggctttgtaaagtgaaactccacaaggatagctcgattctggattttaatcgtgcaattaccctcaatccaaaacattaccaggcatatttaagccgagtagcattctatggtttaaaaggcaggtattccaaagcaatcttgaattgtaacaaggctattaaaatttaccctgaaagcgtacgtgcctatctctacagaggagttctgaaatactacaacaagacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaa

SEQ ID NO: 190621 - DNA, 2253 bp, Homo sapiens
  Payload ID: 17655
  Gene Name: tetratricopeptide repeat domain 6
  Uniprot ID: Q86TZ1
  ENST ID: ENST00000476979
  CDS Start-End: 288-1850
gtgggcgccccttccccagcctcgctgccgccttgcagtttgatctcagactgccgtgctagcaatcagggagactccgtgggcgtaggaccctccgagccacgtgtgggatataacctcgtagtgtgccgttttttaagcccgtcggaaaagtgcagtatgcaggtgggagcgaacggattttccagttgcataaattgaaaaaggcagtaaatgaattgtctcgtgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatgacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaacatatatcatttgctgcatatttggaataccttgagaactgaatttttccaaggttgcagaatctcaaggaaaatgtttcttaaggaattaaataggaatgtctcttaacatttaaaatattttctttaattctttttgaaataatactatacattgtagaaaaagtgtcactgaccttttcatcaatccttgctgacaatgtattaaacagtatacagattaaaaaataa

SEQ ID NO: 190622 - DNA, 2193 bp, Homo sapiens
  Payload ID: 17655
  Gene Name: tetratricopeptide repeat domain 6
  ENST ID: ENST00000478811
  CDS Start-End: 62-1723
tgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatggcttttgattcttttacaaaagctgtgaaagcaaatccagattttgcagaaagcttttatcagcgagggctttgtaaagtgaaactccacaaggatagctcgattctggattttaatcgtgcaattaccctcaatccaaaacattaccaggcatatttaagccgagtagcattctatggtttaaaaggcaggtattccaaagcaatcttgaattgtaacaaggctattaaaatttaccctgaaagcgtacgtgcctatctctacagaggagttctgaaatactacaacaagacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggaagaaagtcttggcctggcttggagtctttcccttgactcatttctgagaactgggggtgcaaccttctcttcaggagtgaatcctcttcaaactcttcacagaaggatgtcaattctgtcccccctccccccaacctgtcccagggatgagatggattttacatcttgaactaattacctaattaagaggaagcaaagttcatggagtattgcctaaaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaa

SEQ ID NO: 190623 - DNA, 538 bp, Homo sapiens
  Payload ID: 17655
  Gene Name: tetratricopeptide repeat domain 6
  ENST ID: ENST00000555921
  CDS Start-End: 1-237
cccaagtactcgctggcttactttaatgcaggaaatatctactttcaccacaggcagttttcccaggaagaaagtcttggcctggcttggagtctttcccttgactcatttctgagaactgggggtgcaaccttctcttcaggagtgaatcctcttcaaactcttcacagaaggatgtcaattctgtcccccctccccccaacctgtcccagggatgagatggattttacatcttgaactaattacctaattaagaggaagcaaagttcatggagtattgcctaaaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaaggtacacttttggtaattattctggt

SEQ ID NO: 190624 - DNA, 511 bp, Homo sapiens
  Payload ID: 17655
  Gene Name: tetratricopeptide repeat domain 6
  ENST ID: ENST00000556845
  CDS Start-End: 397-511
tgagagcttcagactagaaaagggaaaaagccccacttttgcttcgtcactagaaaccgggtcatctgagtcagccgagccaagtgacgttaggccgacccgggccccgggctagcagagcggaggcgctgccacgaaactcgtacctgcggctaagagcaggaaaaccctttcctgtatgccatctgttttctgtggggccctgagtgatgaggagaggaacaaggattcatggaagtgaggtcaaatttgtcaagatgtccacaatcccgagacactttggcctgaaatacaaagaggaatcgtatatgtttaaagagcttgagaaagttcggcaggaaactaaaaaggattttctccgattcaagcagaagttggcctccaagccggctgtagatgaaagcccagtccacagcctccatgcccccggcccggcccgccccgcgcgcgtttcctgcgccgcagcccggacgtcgagaagatacccttcgcttaaaggccctgcgatgtc

SEQ ID NO: 190625 - DNA, 5833 bp, Homo sapiens
  Payload ID: 17655
  Gene Name: tetratricopeptide repeat domain 6
  ENST ID: ENST00000553443
  CDS Start-End: 1-5661
atgtccacaatcccgagacactttggcctgaaatacaaagaggaatcgtatatgtttaaagagcttgagaaagttcggcaggaaactaaaaaggattttctccgattcaagcagaagttggcctccaagccggctgtagatgaaagcccagtccacagcctccatgcccccggcccggcccgccccgcgcgcgtttcctgcgccgcagcccggacgtcgagaagatacccttcgcttaaaggccctgcgatgtccgcggccgccctcctgcaggaggtgctcggaggcgcgccgcgtccctcgggcctgggtgaggcggcggctccaggcaagacccggtcgtttcgcccccgggacttttacttgcggagctccgcgttcctacggcaccaggccctgaaaaagcccccagtcatcgcctcggggttcggcacggccagacccgtggtcctgctgcctccgcccgagccacccgtgaagcgcagagcgcgcggggtcttggagagctcgcggcacgcggctcccaggcgggtcttccacttgggaagggagcgcgaacagagccaggaggtagctcctctcgcagggccctgcatggccaaagagaggaaggccagctccgtctccgcagaggacggctacatggaggccagcagcgggcggaggaaagtgaggatccgcagcaacttcgtgagcgagagcggggcccgcgaggcgcgggaagcggcggggttaggagcccagggagaacaggagagctggccgcccagcgacgcgcgggaggccgcctggcaggcgctgctgccctcccgcgtgatccccacgtccatcgaagagatcatcgcctctctgcagtccgaggcccagctggcctccgaccagaccatcaaagagctcatacggagcgtccttggccagaactacgacattacaatggaagatatttctttaatgggaaaaatgtacctcaaaacatcacctatgcaagcagaaacacctgagatacaagcagagtataaattccagatgggtgctgaggaatcgcaaatgagcgtgcataaggaactttctgaaaccatgtcaagtattctccagattgaacaagaggatatagaatggggaccctcagaagcagaaagcatagtatttaaacctcaggaaatttcgcaagttcagccagcagaggaattaagtaaacctttggaagatggacagcccacaagtgattcaaaagaagccaagtgggtgtctttaacggcaaaatcaccagaattcttgcaaatcgaaggaaaagaaattaagcgaatgcggaaacgtaaatcactgagaccaagaaagtcttcaaaacctctttgtgataaaaaactacataaaaaaattccacaagactactccatgccgcaccttcatgatctgtgcaccaccatcccagcccaggagctgcctgttgacttgcgcctggcttctcgagtgtatcacactgctaacaggaaaggccacgataccctgcttggaaaatttggaacctctttcttagatgatcgctttacagatgaagaacaaacagatagaatattgtatggaattcctgttatggatgacaaccaagaatatgtccatattcctccgacaccgcaagggataccacctgaattggcacaaggaactagagagcgtgctcacaaaccacacttggaagtcttgggagaggaaatgtatgcttatccagaattcacgaagttgttttggaatacagctgcacctaaattctctgttccagaatctgtcatgaaggaaactctatatccaaaatatgagagtgttcaagcaagcagacttttaactgataaattgtcatataaaagcagtgtcattactttacatcaacatagcagaacaaatttttggtgtttcttaccaagaaaatctgcatcatttgaaagtatccaaaaatggtttagtgcacaacctacacaactaaggcgagtaaaatcttctgtagacttgaggaaggagaagatcatagctcctttggaaatcaagaatgatatgcaaagcagtataaaagaggttatgtttcagaaagcaaaggaattgaaacgtcagctccagctcactaagcaaaataaaactgaggagcccaactatgtgaaagaaagtatagatgacatctttgataacatgtgcgaaaaacacagtttgagaaatctctctttgactctcattgaagcgtctaaaaaagctggcattagttacattgtttatcccaagaaaaagaagatgagatggaagaaaagattgaaacaacaaaaacttatattcgtgcatgaagagttatccaagcctccaaaatctcttgaaagatcagcatctcatggaatacttccgggacagaagaaatatttgttcaaagttccattatatgaacgtcaaatacggtgtcccagtttacctttgtatttaaattttgaaaaattcgtccaagctaagggaggaattccagaaaatattgatcctcggacatgggctcttgataggctcattgagtacaaagatgcgagcatacctgtaaaagagaaagatgataaaatatcagttcctgaagacccacctgaaagagtgaaagaaccaccaaaactaaaattaaatgattatgtggagtctgatcttccacaagaggtcattaaatattatgaatctgaagtgaagattttgactgaagaaataaatgataagacaaaatatcctgcatttgcatattgtaggcgtggagctatttataggaaactgggaaagttgcagagtgccatgaatgatctgcagagagtaatactcttggaaccattgtttctcaatgcctattggcatcgacatttaatttatcttttccaagacaaaattaatgaagctttggatgacttgaattatatacataaatataataaaaataatacagaggcatatttgtcaaaagcagaaatttacaggggaaaaaaagacataactttggcaattctaaactatacccaggcaattaaatccacgcccacagatgctgatatctatttcaggaggggtgagatgtatgaaataacaaacaaagtactggccattgatgacttttcgaaatgtattttttatgatcccaaaagaacagatgcattattgaaacgtgggctgttttattgtgaaaatgaaaactggtttgcagccatagaggattttacagccttgttaaatatagatcaccaaaattctcaagcaaggacataccgagggattgcatatgttaaatggaaattttataaagaagcaactcaagatttttctgctgcaattcacttagatcctaataactggttagcgttgtattatcgaggttgcttattcagaaagagtaacccttttagagcgctacaggattatagtgtttcagcactcataaatgatggctatgagaatcttggttgttttctacatcggggaatagtctatgcacatctaaaactttggctgctggcaatttgtgactttgaaactgtcatttctctagaaagaactattactttggcttatgtaaatattggcctcatacatctgctacacctggataactacacggaagctatttggcaattttctgaggctattagaattgatcctttatgtattcaaagctatctttgtcgggcggaaacctattttaagttgcataaattgaaaaaggcagtaaatgaattgtctcgtgctatccaccttcagccagatggaatccaattatacataagaagaggacaatatcttcttatgatgaaatattatgatcttgcaaagtttactatttatcaaatagcagaaatggacaaaggtctcagtgagttgagtcctatgcagcaagcccttatttattcattttgtgaaaaccatgacaaggccattgaggtcttggacggaatcagctggaatagagctgagatgaccatgtgtgctctattagcaaaagttcaaatgaaggccaagagaaccaaggaagctgtggaagtgcttaagaaggctttggatgccatttctcattctgataaaggaccagatgccacagcaatttcagcagactgtctgtataacttgggtctttgttacatggaggaaggcaatttacaaatggcttttgattcttttacaaaagctgtgaaagcaaatccagattttgcagaaagcttttatcagcgagggctttgtaaagtgaaactccacaaggatagctcgattctggattttaatcgtgcaattaccctcaatccaaaacattaccaggcatatttaagccgagtagcattctatggtttaaaaggcaggtattccaaagcaatcttgaattgtaacaaggctattaaaatttaccctgaaagcgtacgtgcctatctctacagaggagttctgaaatactacaacaagacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaa

SEQ ID NO: 190626 - DNA, 3567 bp, Homo sapiens
  Payload ID: 17655
  Gene Name: tetratricopeptide repeat domain 6
  ENST ID: ENST00000533625
  CDS Start-End: 127-1449
agtcgagcccacccggcccctaggcacaggaaaggcctgttggacactcgccgagcggcggggccaagctcaccgccacctgaattggagcggaggcgccctcgatgccgggtcaaatttgtcaagatgtccacaatcccgagacactttggcctgaaatacaaagaggaatcgtatatgtttaaagagcttgagaaagttcggcaggaaactaaaaaggattttctccgattcaagcagaagttggcctccaagccggctgtagatgaaagcccagtccacagcctccatgcccccggcccggcccgccccgcgcgcgtttcctgcgccgcagcccggacgtcgagaagatacccttcgcttaaaggccctgcgatgtccgcggccgccctcctgcaggaggtgctcggaggcgcgccgcgtccctcgggcctgggtgaggcggcggctccaggcaagacccggtcgtttcgcccccgggacttttacttgcggagctccgcgttcctacggcaccaggccctgaaaaagcccccagtcatcgcctcggggttcggcacggccagacccgtggtcctgctgcctccgcccgagccacccgtgaagcgcagagcgcgcggggtcttggagagctcgcggcacgcggctcccaggcgggtcttccacttgggaagggagcgcgaacagagccaggaggtagctcctctcgcagggccctgcatggccaaagagaggaaggccagctccgtctccgcagaggacggctacatggaggccagcagcgggcggaggaaagtgaggatccgcagcaacttcgtgagcgagagcggggcccgcgaggcgcgggaagcggcggggttaggagcccagggagaacaggagagctggccgcccagcgacgcgcgggaggccgcctggcaggcgctgctgccctcccgcgtgatccccacgtccatcgaagagatcatcgcctctctgcagtccgaggcccagctggcctccgaccagaccatcaaagagctcatacggagcgtccttggccagaactacgacattacaatggaagatatttctttaatgggaaaaatgtacctcaaaacatcacctatgcaagcagaaacacctgagatacaagcagagtataaattccagatgggtgctgaggaatcgcaaatgagcgtgcataaggaactttctgaaaccatgtcaagtattctccagattgaacaagaggatatagaatggggaccctcagaagcagaaagcatagtatttaaacctcaggaaatttcgcaagttcagccagcagaggaattaagtaaacctttggaagatggacagcccacaagtgattcaaaagaagccaagtgggtgtctttaacgcacactttatattttcttaaaggcaaaatcaccagaattcttgcaaatcgaaggaaaagaaattaagcgaatgcggaaacgtaaatcactgagaccaagaaagtcttcaaaacctctttgtgataaaaaactacataaaaaaattccacaagactactccatgccgcaccttcatgatctgtgcaccaccatcccagcccaggagctgcctgttgacttgcgcctggcttctcgagtgtatcacactgctaacaggaaaggccacgataccctgcttggaaaatttggaacctctttcttagatgatcgctttacagatgaagaacaaacagatagaatattgtatggaattcctgttatggatgacaaccaagaatatgtccatattcctccgacaccgcaagggataccacctgaattggcacaaggaactagagagcgtgctcacaaaccacacttggaagtcttgggagaggaaatgtatgcttatccagaattcacgaagttgttttggaatacagctgcacctaaattctctgttccagaatctgtcatgaaggaaactctatatccaaaatatgagagtgttcaagcaagcagacttttaactgataaattgtcatataaaagcagtgtcattactttacatcaacatagcagaacaaatttttggtgtttcttaccaagaaaatctgcatcatttgaaagtatccaaaaatggtttagtgcacaacctacacaactaaggcgagtaaaatcttctgtagacttgaggaaggagaagatcatagctcctttggaaatcaagaatgatatgcaaagcagtataaaagaggttatgtttcagaaagcaaaggaattgaaacgtcagctccagctcactaagcaaaataaaactgaggagcccaactatgtgaaagaaagtatagatgacatctttgataacatgtgcgaaaaacacagtttgagaaatctctctttgactctcattgaagcgtctaaaaaagctggcattagttacattgtttatcccaagaaaaagaagatgagatggaagaaaagattgaaacaacaaaaacttatattcgtgcatgaagagttatccaagcctccaaaatctcttgaaagattcctcgaggtctgaacaagaaccactgacgcagaacgtgaaaactagaagcgttcattagcgaccaccctttgtttgactgatgaggaaatcaaggctgatggatacaattggacaaactgattgtgcaactgactccacacaaatctcatttaatcagctttcctaatcacctatctctctatctacctatctatttcttgatcatccgcaaaattgattggcgatagaagacactacctatctgtagtactgacttgaattgaaatgaaaaatcaggcaagtagtggattcaaatggaattttcactttaagccttctttggaagtaatatatttttgtttttcaagtccggaacaaagaaagaacaaagatgatttgatgtagtgcagcagtttgaagataggtgactttctgagatgctatttctggcaattgtggtggtaaatccttcaacatttggatcactgagttcttcgattttcttccttctcttcagaaattgaagttgtaaaattgtttgagaagttttatcagttcctggatgcatttgaataacactaaccagaggaccaagctagtcacaacacaaagcgatggtcacttggagtcatggatccaatatgcacacagttgtggaagaaatgcagagacaatttaatgtgttttcaatgaagaattggcagttgtggaaggaatactgcaggtcctcttctactctcaaaggcaaggaaacttggagctgatttaattattctgcagtgttctactgcaagttgaccagtaagaacatcttcgtttcactcatcaatgaagctctctactggataggaaggccgccgtccatctccagccataggtttaatgaagatgagaacctcagaattgctgcagccatcttgctaccaaggcagaacaaatgagaaagtcagtatgctaaggaaggcagctgaggaaggaagaaaaatcttgggttcctgttgacattgctctgtccctgaaatcttctacctctgaatttcttgttatgaggcaataaacactccaattcttta

SEQ ID NO: 190627 - DNA, 5157 bp, Homo sapiens
  Payload ID: 17656
  Gene Name: tetratricopeptide repeat domain 7A
  Uniprot ID: Q9ULT0
  ENST ID: ENST00000319190
  CDS Start-End: 369-2945
ggccaggggcgggtccgcagctggcggcgccggggcccggggcggaggctgtggcagcagctgcagcggcggcggcggcggcagcgccaggagctgctacagcagaggcggaggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcattt

SEQ ID NO: 190628 - DNA, 4306 bp, Homo sapiens
  Payload ID: 17656
  Gene Name: tetratricopeptide repeat domain 7A
  Uniprot ID: Q9ULT0
  ENST ID: ENST00000394850
  CDS Start-End: 257-2905
ggttgctcctgtacgcgtacgggccgctcggccggagccgcagcccggaggcgccgggcggtgcgctgggagctgctggtgctgctgctgctgctgctgcccaccctccgccgcccgggcccccgctgccgcccgggccccggctgccgtctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggagactttaggagcccagaaggcttccagactccccagaggaacatctgtaacagtgaaatttacagaggaggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaa

SEQ ID NO: 190629 - DNA, 3033 bp, Homo sapiens
  Payload ID: 17656
  Gene Name: tetratricopeptide repeat domain 7A
  ENST ID: ENST00000409245
  CDS Start-End: 434-2908
ctcctatacagggctcttggttcaggtctcttggttcgtcctgctgcaagttgggaagaaagataataggaatgctaattccttcttgatgaaacgaccacaacacgctggagccggccttggaccctacgtttcaagattggcctgcttccagcgtctgccagctccactgcacaagctgcggcagccgctgtccccgttcgcttccacgggagtcccagcaagactatgcgacccagttcaaataccatcttccatgtaccgttcgtgaaatcagcagcttttgacattcaagagaggacagattacttaaaaacagactcatgaacaaatagggaaacgaatacatcatccctgtatcgaattcatccctgtataatcctgcccttacacctgtgctcctatacaagattaacattcaaaaagagtctccatggtgcccagctcgtctcgaactcctgggttcaagcaatcctcccaccacctccgcctcccaaagtgctgggattacagggatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcc

SEQ ID NO: 190630 - DNA, 4739 bp, Homo sapiens
  Payload ID: 17656
  Gene Name: tetratricopeptide repeat domain 7A
  ENST ID: ENST00000409825
  CDS Start-End: 1-199
ccatgccaaaataaaagactccatgcctttgctggagaagaatgagccgaagatgagcgaagccaaaaattatctaagcagtatccttaaccatgggaggctctcgggtctcgctgtgttactcaggctggtctccaactcctgggctcaagcgatcctcctacttcagcctcccgaagcgttgggattacaggagtgaggcactgcgcccagctgatttttaaagagctattccaaaccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaagcatgcctccggcttcttgggggaacacagtcccggtggtcagaggtcctgcaggggaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggagtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccacctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttac

SEQ ID NO: 190631 - DNA, 2418 bp, Homo sapiens
  Payload ID: 17656
  Gene Name: tetratricopeptide repeat domain 7A
  ENST ID: ENST00000441914
  CDS Start-End: 1-992
tggctgcgaagggcgcgcacggctcctacctgaaggtggagagcgagctggagcgctgccgcgccgagggccactgggaccgcatgccggagctggtccggcagctgcagacgctgagcatgcccggcggcggaggtaacaggcgaggcagcccgagcgcagcgttcacctttccggacaccgatgactttgggaaattgctgctggctgaggccctcctggagcagtgtttgaaggagaaccatgccaaaataaaagactccatgcctttgctggagaagaatgagccgaagatgagcgaagccaaaaattatctaagcagtatccttaaccatgggaggctctcgccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaggtgctgcggactgtggagaccaaagcaactcagaacttcaaagtgcctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatgttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctga

SEQ ID NO: 190632 - DNA, 641 bp, Homo sapiens
  Payload ID: 17656
  Gene Name: tetratricopeptide repeat domain 7A
  ENST ID: ENST00000440051
  CDS Start-End: 1-326
atgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaaaggcctagaaaaggatggcagcttcggtgagg

SEQ ID NO: 190633 - DNA, 19458 bp, Homo sapiens
  Payload ID: 17657
  Gene Name: tetratricopeptide repeat domain 7B
  Uniprot ID: Q86TV6
  ENST ID: ENST00000328459
  CDS Start-End: 123-2654
gttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatgggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggactcatagcctgtgtcattcgtaaaagctcaaagacctgagaaaggcttagttcctggggtggggagctgtctgtacctgggggcccactctggacatgtcagcccttgacactagaaagcccagcctctctttccccacttattttatttttattttttggagacagggtctcactctgtttcccaggctggagttcagtggtgcgatcacagatcactgcagcctcgacttcccaggttcaggtgatcctcccacctcagcctcctgagtagctgggatcacaggcgcacactagcatgcccggctaattttgtttgtttgtttttgtagagacgggatctcactgtgttacccaggctggtcctgaactcctggactcaagcagccctcccgcctcagcctccgaaagtgctggtgtgagccaccatgcccggccatctcctcacttataatttgaagatgatccctaggtagggacgtgtttcctgcgtcctcagcacccaggcctcctttttgcagcaacagccctggttttggtttgggaattcgccttagctctcccccgatggggctttggaattggagcatgcaattcagtcctgcccaagcagcctcctgcactcatgggccacagagggtcaggagtgagcatgtgacctaaagcggtccagtcagagcgggagccacagagaaggctgtcgctctttcctgctgcctttcaagctgagaagtgaggctggaactgcagcagccctcttgccaccatgagaagaaggtgtagaggtgtttgagccaaagtccgaatcccacagagtagacagcaagatccggaaccagagagaaactgagcaggtatctgcagtctctcagggacagctgtagggtggccccacctttccaggacacagggaaatatggagggctgagctctgaacttaggtgccctgaagcctagaggactgcattcaaactgggcacgacctctctggctcactgaggcaggcgggctagggggcagccaaggagggagagacagtaggtaggagccccagcctcagcactgaccctgccaggcagcacttgtggctttgagtggtcataagtcatggaatttgcaatgtaggacctggggcaggtactcagtgtggtggcagcttgccctgattggaggcacagggctgggctctgccatcccatgcgggagcgtggggcaaggcccactggatcaggaccaggaagggaggaggctgggccaccaaggcagatggtgcaggcgctgtaccagaccttctctgccaggccctcacctcagagactcctgtgcgtatcagccctgcagggcgcgggggctggctcctgtgtgtctgcccggcacctctccattgtcttcatctccctcagggaaccacccccactctccacccacatggctcaaggatggacacatgggcccagccttaacaaccagagccctccagctccccagtatcagtgactggtttgggtttgggcatgtgacccatgcttggccaatgagaagcacccctgggacttttgttatgaaaacattagaaaaaaagcctctttctgctgggtttgatgtcctaataggatgccagtggggggctgtgggtgccatttgacattatatggggtggcctgcctgagaatgatgccaacacagaaaaagagaatgaggaggtggaaagagagccgggccccgggtcaccgctggagcactgcggcccgagatttttccatcataggaatccatacagtttcccatcttgcttagtgcaagcacaggggtttccatcacttctacctaaaaggtacctaagaaatgcaggaaagtcctgccgtccttggtactccccccttgggcactcttccagactcctcagtcccccaccttaatcccactcacccacctcatattctgttttccagtaaatcttgtcttttctacccaaatcgcatctcaaatctctcccattcaacttcatccccagtaccttggccccagccccacacagtccaatgtctgcacagtcctcttagaagggaggattgagtcggttctctctataaacccctgatggcttctcaagcccttgcctggaaccagactctgtgtcccagccccctgtgtgcctggctgcctctccttccccaagccctctcatggctctggccttcttcctagtcttctgacctgctgagcctttcccaactaaggacattcatccatccgtccatccatccatccatccattcatccgtccacccgtccgtccgtccgtccatccatccatccatccatccatccatccatccatccatccgtccatccattaatagatgaggacgcagacgctagacactaagacggcaggacacctgcctggggtcattgtggaattacctggcagaactaagattgagacaggcctgagggataaacatttcaaaagtgcccaggtctgcccagtggaggcattttttggacagtgagatgcaggagatgccgcgtttgattccaggactagtgctgaccctaacttaggcaaggcgttcctgttccctggtcttagtctccccatctgtgaaatttcattcattcattcactcattcattcatccaacaaatatctatggaatgctcacaacatgccagatgcttattccaggcactgagggcacagcaatgtgtgacacagatgctgcatccacttaggacctaccttctggtagaaggaaacagacagatgaggagtatggcaggtggggtgacgcatggagaaagatgaagccagggaaggggtgtagggagtggcagggctgctgtttagaaggtgactagggaagcctcgctaagaaggtgacatctggctgaagaaagacaggtaacctgggaggaggacatctcaggaagcaggaacagcaggtgcaaaggcccagaggggagggggatggtcaggtggtgaaggatgagaagaggtcagaagtttaacaggggccacacaggtgcggcctcgtggaccatgctaacagtgtatattaattgcctgtggttgcagcaaattaccataaactggctgggcatggtggctcctgcctgtaatcccagcacttagggaggctgaggcaggagaatcagctgaggccaggagttcaagaccagcctgggcaacatggtgagaccccccccccatctctacaaaaaaaaaaaaatagccaggtttggtggcgtgcacctgtagtcccagctgcttgggaggctgagatgggctgattgcttgagcccaggtggttgaggctgcagtgagtgatcacgccaccgcagtccagcctgcatgagagagcaagaccctatctctacaaataaaataaattaaaaattttaaatgaccgcaaacttagcgtcttaacacaaatttattctctttgttttggaggtcagaagtcaaatcaagctttcagtggggctgtgctccttccccaggctctggaggaggacgggtgtccccgtcttctccagcggctagaggcttcctgcggccttggctcgtggccacctcacgtcacctttccttcctctgctccgtcactgcgtcacctttctgcctttgacctcctgcctccctctaaggactctgctggttgctctgggccccctggatagtccagggccattgccccacctcgagagccttcgttcaatcacatctgcatcgctccatctgtcatggaaggcaacatagtcacaggttccagggctcgggatgtggacgtctttgaggggcagggggagcacgttattctgcaggccgcagcgtgggagctgggaggctgtcaggctcctgctgtcacacagcgaccatggtgcttagaccaaggggcgtggaggaagtggcgagaggcactggactgtgaagattctgaagacagagccaagagggttgctcacacatggagctgggtgtgagggaggggagacgccagggatgagggtgagggtcttgtcctgagctactggaaggatggcgatgatggccaggaaacaggaagaataggttggggaggagaggagaaggcaggagtctgctttcaggcaggttgaatacaaaatgcctgtggagcctctgagggggaggcagctggctgggcaggagcccaggcgagagcccaagatgaggcgagagtgtgggaggtgtcagggatgcggggctgggagccatgggcctgacggggccacttcgggacaagcatagacaaagaggaagaggtcagggctgagctccggggctggcggggtttacaggctgggaaatgaagagatcaggaaagaaggcgcaggagcagctgcaagggaggcggagagcaggcagggtgagcttcctggaggaggtgggtgggctctctcaatgcctggagaccccgtcagggtggcctgagagctgaccgtgggcctggtggtgtgcaggttggcagtgaccttgaccagagccatgctggggatgcagttttgctcccccagattcatagggtggagcccccgcccctgtgtgactatatttggagataggccccttaaggaagtaattcaggtgaagtgaggtcatcaggaggggccctggcccagtaggattggcgtcctcaccagaagaaactctaaagtgcaagtgagctcacgctcagccacgccaggacacacggagaaggcggccacccgcaagccaggagggagcctcacaggaacccagatgggctggaacctttgctttgttctttgaacctccaggactgtgagaaattaagttcattgttgaagccacctgtctgtggcggttttcttacggcagcccaagctgactaaggtggggtcaagccaggttggagtgggctcaagggggaggaaaaggtgaagtctctttcaagagcgtagctgcagaggggagctgagaacacaggttaggagtccggtggggaaggggccgtgttgagtgttgaaggcggcctcgctgagcaccttgtgtttccagcagggcaggcgtgaggaaggagagagggaagctgaggggggctgccttggctgggggcctggtggttccccagagcagcagcagcagggaggcagaggcctgggtacccccaagccagggagccctggggacggggcacccactcctcagtgagcagggagccaacttcgggcagggtggggtggcgaatggaccaggaagggaaggaggaggcagaggagggaggaggcccttctttgaaggagccgccccactcagccaagaggatctcaggacagagccaggctgggggcctgggcaggtgtggccggggcaggccacttcccatccccagccccatttgggatccatgggctcgtctgtctgtctctctgcctccttccaggtcctgggccctgggctgtggccagggctctgctcaccctcagggctgcgtggggacctccctcggtggggaaaggagggaaccaaggcctcccgttatcctccatgccccctacctgtggtcatggcctgggggaggtgcatgctcgtgcacaggtgggcgtgtctgtgatcacatggagcaacccagactcctccagatggccccacgcatctccccggcggccacacagtcatcattgcgggcccagactctctgcctgcaggaagtcccccctttgcaggcaccctccccatcatccttggagttctccacgtctgccctgtccgtgctgggcctgtcaccagcctgtcacctgctgccccagccccagcccaggtccctgcagcacagccggctccaggctggaatgggtgacccggccctactgaaggaatttcagggcagggtcagccactctggccactgtctccctccaatgcccccataccctcccagcgctcggcccctgccactcggccccctctctccatatcgccaccttctcattcctgctcctcccccaccacctctcaaggccgacagggtgggcattgcccagtgaggggacaccactcatattgaagttctgtaaactgtgtcttgggcactgtaccaggtggctgctcccatccctcccctagcgtctgcttgccctgtccatcctgcctactccagaagcagccacacacttgaccataagcctttgaggcctggccggagtcctccgggggaggcgggcagtagcagccgcactgggcctgaggaccccacacaggaaaatgggccgagccccagggctgagccttagggctgcggccgttcccgccactaacattcctcccacacttgtggtcatgcatttcctgctgcccctgcccacgctgcagccagataggaacagaaaaaggacatcctgcaccatttcagacaggaatgtgctcctcctgaaggtcttttgggggccaggctgaggccccccctcaaggtcacaccgtgggggacccactccagctctgcacctgctgggggtgatcctcactgtgccactgtccctccctggactcagaatcagatgaggacagtcacctctgcccagcctgccttctgggctgagatgtgagtctgcaggcagctgtcagaggtggtgtgtgccaggtaggggacacgagggctaccgcccctcaggaccaccacacagggcctcagggccaggccagcaggcaggactcctcctggacactcaagccctgagtggggctgactatggagaggtggcaggaaggtggtgggggatcttctgcaggtctgcctggagccagcagctcccgctgaccatccgggccacccacagcccccaccaccctcctcgtctccctcatcttctgctgtttggcccttgaccccctgaggacaatagggtttcctggtgaccactgggctgtgggtcacacagatctggctggaatcccagttctgcctggccgtgtcacctctgatggggaagcactctgtctcctcatctctatggtcggggagtaacttcccttacgggcttttggggatattaacagaggtcaacctggacagggcatggggcccccggggtgcaccataaagtctttccttctttcttctatcctcaggcgaggggtgagtggctgctgggacgtgctgaggggtccctgaagcagggcaggaagggcagagctagctgcagctgaggcagagtccgagtcccgctctgcatggaggaggaggtgaggggcctggtcagcatgggcatggctgggggcctctgtgaccgccaccactcttgtctttgcctccttgaccccacagggtcatcctcgggccctgggtccagccaaggcctgaggagggtcatgcatccctgtcccacttggtcacagcacaggaggctcccatccgccactgcctgaggcggtgcctgtggcccaagggctcgggttgtgggcctgctgggctggagcctgcatcgggacctggccacctactctcctaggagccttaggtgagtcactagtcctctctgagcctcggtttcctcatctgtgaaatggggagaacaaggtggttgtaaagattcagagggtgtgtaaaacacaagcacatggccgagcacagcccagccctacccctgcatggctcctcccccgggcatggcaggaggtcagggtttccagcctgagcttagcctgccattcagcagtacccaggaaggcacagctaccaggaaaatgacctccccaagcccatggaggcttcctgagcacccagcccagcctgaacctccacccacccaggtggcagtgaggccttcctgcctgtgttcagccacggtgtatcaaggacccctggccagacacaggtacctgggctggggagctggtggtcttattggggactgggaagacagaccccaaacagaggggtaaacaaataagataattaccagcttggcagatgattagagcaaatttgaagtgacagggggagggttactttagattggctggtcggggacacctctgtaagacagtgacattgagtgacaagaaggtgcccaccctggaggacactgggcttcttcacctttaagagggatggtgagcagaagcccaaaagcgtcaggttctgccactttgtaccagatgactaggcccagccagtttgcaaaagggctggcccatcctcacattggcccatcctcacattgccagcaaggaccagaccatgtgaagagggaagagcatcctgtaatgtacaaataggggatcaactttaaattatctccagagtttctttctttaatatgttgtccaaaggtaactatgttaatttttacaaatatttttatgtagttttatatagttttacaaatagttttatgtagttttggtttttatttgtttgtttttgttctacttgagatggggtcttgctctgtcaccgaggctggagtacagtggcacgatctcagttcactgcagcctccacctcccaggctcaagtgatcctcccacctcagcctcctgagtagctgggactacagatgccaagccccactaatttttttcagagacagagttttgccatgttgcctaggctgatctccaactcctggtctcaagtgatctggtcccctcagcctcttaaaggtctgggataacaggtgtgagtcagtgtgcctggcctatgtagcagtttttaaaactacaaaattaaataagaaaggggcagagctcagacacaatgagacttttcagtccagtgttttcagattctctggctttcaactttacaatttcacttcaaaaatttcaacttcaaatttcacttcattgctttcaaaatcttgagccagcttgtcctttggatctggactgtgcctgtctgcactggcagatggacagagctcctgtatagaaatgaagccagttcacccacggcttttttttttttttttttttttttgagaaggagtttcgctcttgttgtccaggctggagcgcaatggcacaatctcgactcactgcaacctccgcctcctgggttcaagctgttctcctgactcagcctcccgagtggctgggattacaggcatgcgccatcacgtccagctgatttttgttttttgttttttttttgtttgtttttttgttttgtatttttgattttttgtgcttagtagagacagagtttcaccatgtaggtcaggctggtctcgaactcctgcttcaggtgatctgcccgcctcagcctcccaaagtgctgggattacaggcgtgagccactgtgcccagctgtttttttgtttgtttgtttgtttgtttaagcaagcagctttttcttttcttttgtgatcgtaaaacctacacccactgtatcagctgcctgttgctgctacaacaaattgccacaaatatagtggcttaaaacagcatacaattttttctttcttttttaagttataacaatatattttaatctcataacaacttcaactgaatacaaaactctttacattttcagctattaatattaaaattatatcattttatatcctgtatctattaacagagatttatgcagatttacattttgttcttcaaattctatagaattttaattttttattttcataggttattggggaacacagtggttacatgagtaagttctttagtggtgatttgtgagattttggtgcacccatcacccgagcagtatacactgcacccaataaaacaacgcacatttcctgtcttacatgtagttctgggggtcagaagtctaaaacgggcctcatggggcaaaaggcaaggtgacggcagggctgttctttctggaagtactaggaaagacatcaaactttgccctttccagtttctcaggggtgtgcttggctcatggccatgttcactgccggcagtggcatcactccgacctctgctgtagagcgatctctgtgactcctccttctctgcctctgaccctcctgtctccctctttcccttgtaagagcctcctgattacattggtcttacctggataatccaagacactctccccatctgaagatccctcatcaaatggcatctgcacagccccttttgccaggtaagtgaccatcttcacaggttccagaaagtaggatgcaggcatcttttgggaccatcatttcacttaccatagtcaccttggggacaatttcagacatacgaagactaagatcattaaattccactatttagcgctcaccttctcagcattttggcctgttgtcttgcagcattctcccatgagtatagatttttttgttttttgggatggagtctcgctcaattgcccaggctggagtgcagtggtgcgatctcggctcactgcaacctccacctcccgggttcaagtgattctcctgccccagcctcccgagtagctaggattacaggcacgtgccaccacgcctggctaattttttgcatttttagtagagacggggtttcgccgtgttggccaggatggtcttgatctcctgacctcgtgatccgcccacctcggcctcccaaagtgctgggattacttacaggcgtgagccacagcgcccagccaagtatagatatttaatgaagtgaaatcatactatctataacaccgtatggatcttttcacttaatattctcttgtcagtaaaaatctttctagataacttagagacagcataacctcccctcacatggatgcactgcagactgtttaaccctttctttattgtcaatgatttaagtggtttcacattgtcatgccacatacaatggaatgggtaatgccagctcacaattattgagcatttattatgcaccaatcattcgacatgtattaactcatctaatcctcatgacagtgctatgatatgcatacagttattacggatacaggtccaggtgagaaatgaagctctcttcagaagatgaacaaacttgcccaagtttgggtaatactacagcaggccttgaacccaggttgcctgactccagaatccatactcttagccactcacatgctcatgttttctcctagcatctctgattatctatcttagggtagaattcggataggcagaatggcagttcatcaggctatatttattgagggcttagtttgtgcattttccatgggctcactgagttaatcctcatgactccaagaagtggtctgttaactggccgaagccacgctggttggctccagtagctagactctgcctggaacctctgtgtggtagccagtcattagcggtggtgagggctacggcctctccctgacaagctcaccttgccagacggtgcccccatgaatgcaaaatgcagtcagatcccgctatcggaaagaggtaacaaagcgcagtcaggtcacgccatcagaaacaggtaacaaagcgcagtcaggtcacgccattggaaacaggtaacaaagcagtcaggtcacaccatcggaaacaggtaacaaagcgcagtcaggtcacaccattggaaacaggtaacaaagcagtcaggtcacaccatcagaaacaggtaacaaagctcagtcaggtcacgccattggaaacaggtaacaaagcagtcaggtcacaccatcagaaacaaacatcagaaacaggtaacaaatcacagttgggtcacaccaccagaaacaggtaacaaagcgtagtcaggtcacaccatcggaaatgggtaacgaagcgcagtcatgtcacaccatcagaaacaggtaacaaagtgcagttgggtcacaccaccagaaacaaccatcagaaacaggtaacaaaacacagtcgggtcacaccatcagaaacaaccatcagaaacaggtaacaaagcgcagtcaggtcacaccatcggaaacaggtaacaaaacacagtcgggtcacaccatcagaaacaaccatcagaaacaggtaacaaagcacagtcaggtcacaccatcggaaacgggtaacgaggcacagttgggtcacgccatcagaaacaaccatcaaaacaggtaacaaagtgcagtcgggtcatgccatcagaaacgggtaacgaagcgcactcgggtcacaccgtcggaaacaggtaacaaagtgggaggtcaaggctgcagtgattatgccactgcaccccagcctgggagacacagcaagaccctgcctcaaaagaatgacaaaaataaaataagttgctctaccactttgcgtggtcacctgcagagtgtgaaagtgtccactcacaatgtggccctggttcttaactgaccatttggagggttgtctgtagccactgaaacccagactccagcttcctccaggctctctgtccggctggacagaaggaggagctggtgctgctgtttagccagccaggggattggaggctcacagcaggggagcgtggggctgtcacccattcctgtttccatggtttgtatgggtaaccgggaggcagcaggcgaccccatggctatgtcatccacagagagaaaccttatcacatacggaagctcttattcatacaacatatgccaaccttgtcaaccaataaatgcctatggagcctttactctggatcaagacatccttccaagtgatccacccgcctcagcctcccaaagtgctgggattacaggcgtgagccgccacacctggctcgccattttcctttagcttgtgatgtgatcataaagtgagtcacatctgccaggcgcagtggctcacgcctgaaatcccagcactttgggaggctgaggtgggtggatcatgaggtcaggagatcaagaccatcctggctaacacggtgaaagcccatctctaccaaaactacaaaaaattagctgggcatggtggcagacacctgtagtcccagctactcgggaggctgaggcaggagaatggcatgaacccgggaagcagagcttgcagtgagccgagatggcgccattgcactcccacctgggcgacagagtgagactccatctcaaaaaaaaaaaaaaaaagtgagtcacatctccctctggatctcagtttccttgtctgtaaaaatggtaaagaaggttttgactaagtgatccctgagcctttgtaactgcgaatttgctaagtttagagattattaggacttctaccagagggacagtaacaggggtggggttaagtgaaacatcaatgtgaagtgcctggcgtagaagatcctcagagtcaagtgaagcttggggagcttcatcactggagtgtgggctggacttggtgacttgcattcagagagaaggatgtggaaataggaaaaatagtaacattaccacagagaaacctggcaggacatcaccttcaccagtcaatgaaggtcagcattcccagtgatgagtcgtgtgaataccaggtacccccagatatgatggggtgagcagggcacctcatctctgtggtcttcttcccccaaacccataactccagtgtaatcatgagaaaacatcagacaaacccaaaccgatgaactttctacaaaatacctgaccaatacccctcaaaactaccaagagcatgaaaaagaaaagtctaagaaactgacgaaaaccagagaagcccatgaagacatagctaaatattaggtggtacggggtcctggatgaaaggcaccgtattagtacgtcctcatgcagctaataaagacatacccgagactaggtaatttataaagaaaacgagtttaattgactcacagttcagcatggctggagaggcctcaggaaacttacaatcatggaggaaggggaggcaaacatgtccttcttcacatggcagcaggaaggagaagtgccgtgcaaaaggagggggaaaaacccttataaaaccatcagagctcatgagaactcactatcatgagaacagcatgagggtagccacccccatgattcaattaccttgcaccgggtccctcccatgacatgtggggattatgggaactacaattcaagacgagatttgggtggggacacagccaaaccatatcaggcacattcgtattataagctgctgacatctaaataaagtctggagtttggttactagtaatttatcaatgtcagttccattgttggcacaaatgtgccaggtaacataaaggttatattaggggaaattgagtgaagggtaaatgggaattccctgtgttatctctgaaacttttcagtgaatctaaaattatcccaaacttaatagtttatttttttttaaagtaaggtctaggccaacaagcacatgaagaaatgttcaacatcattactcactagggaaatgcaagtcaaaactccaagagataccaccttacacccactaggatgtctataatcaaaaagacagacaataacaaatgtttgtgaggacgtggggaaattggaaccctcatacgttgttggagggaatgtaaaatggtacagccactttggaaaacagtttggcagtttcttaaaaagttagacatagaattatccaggaattcctctcttagtatgtaccccagagaaaaggaaatatatgtacaaatataaaatacaaagacttcttttttttttttattttttttatttttttttattttttaaccaatcgcaactctgtacgttggtattattctaagggagcaaagctttgccccaacccccacccccatgtcctggtactcttccactctgagagctttagaaccggggttccaaagtctctgcttagcctaacagtgacgtgcttgtcacaaagccagaggccggtgtactcgggttagagagggcctttgtcgttgggttttattcttattgtattattcgggctccaccgacccaaatattagtcaactgggttgggcgaggtaggacggatgaagcccaccgtctaacaatctggacatctataggagcagatccgccgctcgaaacagctgacccagcgacgactgcggaaccactagcagcgtctgcacagatcgaccccgccatcccgccgtcccgttcggtgaccggagacgcagccgggaacgcgactgatcaggctaccgagccgggccgcagggcgaaagcggtgcggtccgaggcctcagaaagggacacgcagcagcggcagtggcgctgactcagcccggcctccctgcagtcccctcaaatacaaagacttctccgcaaatgtttatagcagctttatttgtaatagccaaaaactgatcacaatccaaatgtccaccaacagatcaaaggagaagcgaattgtgatctgtccatatgaggggcttggtgcctgcagcaacatgggtgaatctccaggtagtggtgacgagttgaaggagccagtcaaaaaagaacgtgctgtgtgattccatttatagaaaactctagaaaatgtggactaatctagagtgagggaaagcagacccgtgattgcgcctggggcaaggagacttgggggtggagggggggccagagggaggggtttcaaagatgataaagacattttgagggtgatggatatgatccctctcttaatagtggcgatggcttcatggatagatacaaatgtcaagacatattgaactgtatactttaaatgcttgcgctttactacgtgccaatcacatcttcataaggctgttttttgtttttttgtttgttttttttttttaaaaaaaaaggcctcgtaatggagatgagtacagcctggcctcagtctccccacctgcaatgtgggggatccccgtgtgccttgcaccacctgagagctccaggcttaggaggagaccgaggtgagccctgtttctagccagaaaccccaaggccctaacccccagggctgggcagctgcagggcccaggctactgcccctccggggatggacggtgcgaggccactccaggggcatgacctgttttgggcaggcggtggctgtggggagaagagtggggaggtccctttcttttttcttcctgaataaaaaaatgcatgatgcta

SEQ ID NO: 190634 - DNA, 591 bp, Homo sapiens
  Payload ID: 17657
  Gene Name: tetratricopeptide repeat domain 7B
  ENST ID: ENST00000555239
  CDS Start-End: 1-317
gtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgac

SEQ ID NO: 190635 - DNA, 630 bp, Homo sapiens
  Payload ID: 17657
  Gene Name: tetratricopeptide repeat domain 7B
  ENST ID: ENST00000553948
  CDS Start-End: 487-630
ggggccccgccgcgcccgccgccgccgcccgcctccccgccccttccccagccggcgctcccgttacgccgcggagccgggagccggagcccgagcccgcggcggcggcgggaggcggcgagggggcgccgcggcggcggcggtggggcctgcggggcgggcggccgggcccggccaggccgcgatggcgaccaagaaggcaggctcgcggctggagacggagatcgagcgctgccgctccgagtgccagtgggagcggatccctgagctcgtcaagcagctgtcggccaagctcatcgccaacgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactt

SEQ ID NO: 190636 - DNA, 708 bp, Homo sapiens
  Payload ID: 17657
  Gene Name: tetratricopeptide repeat domain 7B
  ENST ID: ENST00000557766
  CDS Start-End: 95-708
caagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatggagggacagatggcaatattaaagagccgagaatgtggttcagagtcatagaacaggacgaaaccaggaacttgacaagaggagtcggaagatttagagagcttctcagagcagttgaaacaagaacgactcaaaacctgcgaatgacaatagccaggcagctggcagagatcttgttgcggggtatgtgtgagcagagctactggaaccctctggaggatcc

SEQ ID NO: 190637 - DNA, 1719 bp, Homo sapiens
  Payload ID: 17657
  Gene Name: tetratricopeptide repeat domain 7B
  ENST ID: ENST00000553972
  CDS Start-End: 1-993
atcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggcaactctccagaagcatactttcatggttttccttcccttttttcagttagctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgaca

SEQ ID NO: 190638 - DNA, 2730 bp, Homo sapiens
  Payload ID: 17657
  Gene Name: tetratricopeptide repeat domain 7B
  ENST ID: ENST00000555005
  CDS Start-End: 1-1254
acaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggaaatcagtgttcatggattgcatttggggaaatgctggtggatatggggatccagtgcatttgaatgacctgagcctttagcttatggcaaatactgcccctcacccttaagagttgattccaccctctgaaatccagctcaacctagatgtgcctttatttctggcctaaaagcagtccataatagaaaagaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatgga

SEQ ID NO: 190639 - DNA, 525 bp, Homo sapiens
  Payload ID: 17657
  Gene Name: tetratricopeptide repeat domain 7B
  ENST ID: ENST00000554462
  CDS Start-End: 1-525
tttaacagcaaggagttttaaagccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccagacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagag

SEQ ID NO: 190640 - DNA, 864 bp, Homo sapiens
  Payload ID: 17657
  Gene Name: tetratricopeptide repeat domain 7B
  ENST ID: ENST00000557292
  CDS Start-End: 1-814
aattactttgccagacttcagcgatcccgagacagtgtcagattcctcctcctcctcctctcctctttcaagaaccgaatctcctctccacctgtttgtgtcttctcatcttcattctcccaaacccgatacctttgtgtggccccctgcagctcattcattcagtgacgcaggtccccgccgggaaccctctctctgcaactctccagaagcatactttcatggttttccttcccttttttcagttagctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccg

SEQ ID NO: 190641 - DNA, 738 bp, Homo sapiens
  Payload ID: 17657
  Gene Name: tetratricopeptide repeat domain 7B
  ENST ID: ENST00000555894
  CDS Start-End: 1-642
ttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcaggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctct

SEQ ID NO: 190642 - DNA, 2058 bp, Homo sapiens
  Payload ID: 17658
  Gene Name: tetratricopeptide repeat domain 8
  ENST ID: ENST00000346301
  CDS Start-End: 53-1480
acgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacca

SEQ ID NO: 190643 - DNA, 2226 bp, Homo sapiens
  Payload ID: 17658
  Gene Name: tetratricopeptide repeat domain 8
  ENST ID: ENST00000338104
  CDS Start-End: 53-1648
acgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactattcatcttgaagatgtagttctacatcttggaatttacccattcttattgaggaataaaaatcacattgaaaaaaatgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacca

SEQ ID NO: 190644 - DNA, 2329 bp, Homo sapiens
  Payload ID: 17658
  Gene Name: tetratricopeptide repeat domain 8
  Uniprot ID: Q8TAM2
  ENST ID: ENST00000345383
  CDS Start-End: 197-1744
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaccagatcctgaattgccagtgcatcaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcatttc

SEQ ID NO: 190645 - DNA, 1342 bp, Homo sapiens
  Payload ID: 17658
  Gene Name: tetratricopeptide repeat domain 8
  Uniprot ID: Q8TAM2
  ENST ID: ENST00000354441
  CDS Start-End: 49-801
ccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcc

SEQ ID NO: 190646 - DNA, 2297 bp, Homo sapiens
  Payload ID: 17658
  Gene Name: tetratricopeptide repeat domain 8
  ENST ID: ENST00000358622
  CDS Start-End: 759-1712
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggtatgtacttaaaatgattttgagttatgaagtaatattacacgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcatttc

SEQ ID NO: 190647 - DNA, 2171 bp, Homo sapiens
  Payload ID: 17658
  Gene Name: tetratricopeptide repeat domain 8
  Uniprot ID: Q8TAM2
  ENST ID: ENST00000380656
  CDS Start-End: 47-1594
acctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggaaccagatcctgaattgccagtgcatcaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacacc

SEQ ID NO: 190648 - DNA, 2209 bp, Homo sapiens
  Payload ID: 17658
  Gene Name: tetratricopeptide repeat domain 8
  ENST ID: ENST00000536576
  CDS Start-End: 197-1624
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcatttc

SEQ ID NO: 190649 - DNA, 479 bp, Homo sapiens
  Payload ID: 17658
  Gene Name: tetratricopeptide repeat domain 8
  ENST ID: ENST00000553718
  CDS Start-End: 115-240
ggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccagtcctgctcctgatggatctccacagagccatgcctgtccttggtctctccacatcctacggtagtctgtgttccatccttgctgtcatcccacatactcagcagagtcctgctctgggcccagagtgtctaggttcaaatactgcctctatacctttgagccttgtagaactaataatgcagtctactcattgggacttggagcttaaatggaaatgaccaagatggattagaaggatatgaaaaataaag

SEQ ID NO: 190650 - DNA, 2113 bp, Homo sapiens
  Payload ID: 17658
  Gene Name: tetratricopeptide repeat domain 8
  ENST ID: ENST00000555057
  CDS Start-End: 37-597
tggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggtatgtacttaaaatgattttgagttatgaagtaatattacacgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaat

SEQ ID NO: 190651 - DNA, 599 bp, Homo sapiens
  Payload ID: 17658
  Gene Name: tetratricopeptide repeat domain 8
  ENST ID: ENST00000556651
  CDS Start-End: 24-599
cttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttggatctggctgccctctccaca

SEQ ID NO: 190652 - DNA, 1020 bp, Homo sapiens
  Payload ID: 17658
  Gene Name: tetratricopeptide repeat domain 8
  ENST ID: ENST00000556077
  CDS Start-End: 197-832
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccagaaaattagctgggcgtggtggcacgtgcctgtaatcccagctacttgggaggctgaggcaggagaattgcttgaacccaggaagcggaggttgcagcaagccgagatcacgccattgtactccagcttgggcaacaagagcaaaactccatctcaaaaagcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaat

SEQ ID NO: 190653 - DNA, 794 bp, Homo sapiens
  Payload ID: 17658
  Gene Name: tetratricopeptide repeat domain 8
  ENST ID: ENST00000557580
  CDS Start-End: 1-794
aagtattcccagaaacctaagttggcaaaggctttgtttgagtatatctttcatcatgaaaatgatgttaagactgttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgata

SEQ ID NO: 190654 - DNA, 1859 bp, Homo sapiens
  Payload ID: 17658
  Gene Name: tetratricopeptide repeat domain 8
  ENST ID: ENST00000554686
  CDS Start-End: 1-1313
cctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctatta

SEQ ID NO: 190655 - DNA, 2377 bp, Homo sapiens
  Payload ID: 17658
  Gene Name: tetratricopeptide repeat domain 8
  ENST ID: ENST00000614125
  CDS Start-End: 197-1792
aggacctcgagaaacagcggacaatttcaggatttaggactttaggtcttgatgggtggatggcgcgctgcgggcacctctcggacaaggccccagccgtcgcgggttgccgggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactattcatcttgaagatgtagttctacatcttggaatttacccattcttattgaggaataaaaatcacattgaaaaaaatgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcatttc

SEQ ID NO: 190656 - DNA, 5270 bp, Homo sapiens
  Payload ID: 17658
  Gene Name: tetratricopeptide repeat domain 8
  ENST ID: ENST00000622513
  CDS Start-End: 85-1602
ggcagagtcggacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggcttccatgcttacaagtcctgatggaccatttataaatttatctaggctgaatttaacaaagtattcccagaaacctaagttggcaaaggctttgtttgagtatatctttcatcatgaaaatgatgttaagactgctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttaaaataaatcattgtgtaaaacaccatcatttcattattttttaatgagtttttattttagtcatctcaggtgaaacaggttttacagaagtccagtaatcttagaaatcatcattattttaattttatttcaaatgatataccaccaattctgttttttcctaaaaagtgatttatgggatgtcacattattaataataagaatattcagattagaaatagagtcacaggccaggagtcccacttctggtcagccacagcacggaagtcagcaatattccagtaccatgcatggcatagcagccttagaaaggctcttgaacttttctctgccttatttagtggaactcttattaaagtgttcacacaaggaaatgtgttaatgggacaggaccactcaaactcatactttggactttgggacctccatgttatttttcatttttttaacttcatgaaaactatttgatagatacttctattcttttcagatttgtataaattgtatactcagctgagagaacaaaaaaattgaattcaaggaatgatagcttgctcaaggctagcattcactacagacaagaaagcaaggccccgcgtcacatccatagctgcagcccaaggtcttgttcctgcaccttagacttgaacctttcttggttctctgtgatgtgttagtgtttatttagcccttgagaatttcctcaggtactatcacatttcctaatatcgtagtcaatatttagattcaaatggtataatgtgaatcattttcttaatttaaaataagagctaataagaatggctgaacatttactgaggatgttaaatatgcccactgttctgagctctttatgggaatgaattcatttcattctcaccgtagtcctatgcaggctgttattccattttacttatgagaatactgaggcatagtaaaaagcttattgaactagtagtaagtgccaaagattcaggtttaggcagcgtggcctcttgagtgtgtgctcttaatcactaggtcaaatcacctctctctgtttctgctgtaaataaatctactaccatttaaaatgaacattgtgtgcattaggaaagttgaataataagggaatattaacacagcaaaaaataaatgattccattttcctaaggtgatatggagggattttgtcttgaatttatgtgaattcagtgtgagcatgaaggcaaagaatgagtcacagtggctcagggcagaatgatgacatagcaccgtggatgactgtatcagaagcgacattcaggatgtctttgtaacaacatttcctatggactgcgtaacttctggcttctgtgccaacatttctgtagaaagaacacaaaaaatactaataattgttttccagttttccactgtggctaaagaggtgctcaatccataaatacaaattgctcaaccaaaattcatatcatcgagcatatttccaactgatgaaaatgagatctggcaagaaggcttcctgcgctaaaacattactgaggttagaagttcttccttttttacaaatgtgtcatggctgagccagtccccatagtgataactcttccattgcatttctgagtgctttttcccaggctcagattatctatcaggatacaatttatggcctacagataagaaaattaataaaggtaacgtgtcactacattattattattattattattattattattattattattattattatgacagtcttgctcggtcgcccaggctgaagtgcagtggcatgatcttggcttactgcaacctctgcctcccgggttcaagcaattttcgtgcctcagcctcccaagcagctgggattacaggcatgcaccaccacacccagctaatttttgtatttttagtagagacagggtttcaccatgttgctcaggctggtctcaaactcctggcctcaagtggtccacccgccatggcctcccaaagtgctaagattacaggtgtgagccactgcacccagcgtctctacacttttagtttccaccaccaaccctttactacaatgagggatttctgtcagggtctttcagctgggattgaatttaagcattcagaaaacaaatattttagaaaggctggcaggactaaaccttagaaaataacccagaaatcaagtgtaggaaaaaaagccatcaccaaataattttgtattctaggaaatagagaaattggaatgttccatgtttatgttccttgcagagttccaaaatggtcatctaggctcagatttgagggggaaacatttatttagcaatttgaaaataactgcactttcatatctatccatatagatggcattcgtcctatttttagctaaataaaaacaacatttttgagagagactattatttcacttctttgatgtcaaagccagtccttgaaatgaaagaatagacatgttgttataatccttgggaactatgtttcttgcaatgtgatccttttctttacctgaatctaattctgactaataagggaaagtggattgttaagtgaaaacaacgggaactcttggtgaaagcaaccgtgttatcttggagaagaggctagacctaaacagattttaggaagaattttgttttctttttaaatcagaaagagagaccctcttccaatatttgaaactcaagtttttatggactccagcaccttgcaactgtcaccgcccccaaaccccacccctcttctggtctaatagcttcaatttatttctctctactggattatgtcttttttaaaaatcacatttcctttaagcctgcctccctttttaaaaatagacaatataactgtttattaaaataaaggaagagaaagaaaataacctgaaaaggaaactcataaaagaaattaaaatggttgataaacatatgtaacaaaaaaaatttgataacagaatgaaattaattcaagagaaagatacatttttaacctcttcagagaacaaagatttgaaatgtttattatatatgaggtgaaggtactgtcaaaattcactgttgggcatatatatcattacaatcttgagagtagtgtggcaaattttattaaattccttccattt

SEQ ID NO: 190657 - DNA, 5217 bp, Homo sapiens
  Payload ID: 17659
  Gene Name: tetratricopeptide repeat domain 9
  Uniprot ID: Q92623
  ENST ID: ENST00000256367
  CDS Start-End: 344-1012
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcccggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaacaaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatgctatacttagttgcctctctgtaagtataatattgggcaattataaccatttgagaacaggacaatatgtattaacctgaaaagtgttcatgatgtcagtgatagtacatggcctccttatgtatttactcaagggccccaaaagaccagaggccagaatccctagtagtcagagcagtgacaggtcagaaaaaggcagctgaggtccaatagttatgtctgtgtattgctcattctacttactgatggagccagcatgtatctcaacaactcacctagcattcatcacccatccccagcattgggaaagggtcacaattaagaccgaaaggaaacacaaagttaaatatgggttaattatgtaagcagatgccccaccacggcaggatccaatcacagccgaggggcccagaagagagcagcgtaagttatattcacatagttccccaaaggctttcaacgggggctacaggaaggtgctagaaatattgaggggcctgccattactcacctagagctcactctctggagaagaggaaaaggaagaagctatttcagctgccacattctccccaatccctactatattatgctgtctttcctcttcctcctagctggctttacatgaccctaacccaaaactaccctatggccccacacgggaatgtgttcaaacgccccgacccccacccccacccccattcccaagcctccaacttagaacgtttgtgatttggcagatggtttgttaggatctgaaggatgaagagaagggtagaggtcacctggagaatgagttcaaactgccagggtcttcccttggtctttgtgcgtcaggaaggactccgagtaattattccctatgcagagacaggagagaggtcttgtttacatgagtgtgctggggcagggctggacaatccaggatatgattgtagccatcccatgtagaaagatcaaaaaccagaacgaaatgaagacagcctctcagaacctcatagaacaagcgtccaggtcatctgcttgtttggtgacttagatatacaggcttactggaactccattcactgtgacctgaagttaaataatcccaaagagaaaaagctacctggggtattggttgatgtttggggtgatagggctgaattttctgtgcatttgtccaacaaaggctttagagcacaaaaccaggttcattctccctaccaaatcttcagcttccttctcctcatccctccccaaaacaagaactgtgatttaattccgtacgttgcggatgtcactgctgacctatgtagctggagtactaatcaggcatctgacctgcactgtcatcccctgcctggacttttgcgatggactctttgggggaaaaactaacgctttttaattattgtgaaagcatcatgtgtgtattgtagaagttttaggaaaaaaaggacaaaatccaatccataagcttaccacccaagacaaacgtgtattcttttgaatataccttttagttctttttggtgtaaatgtacacacgcacacacagttgtggatttttttaaacaaaaactggatacactgaatatactctttaataacttttcaagtgtgtatttatattttagaatatgtaatcctacacagatacaaaattcaaaaagtacaaactgctctgtagtcagaagtaaatcttctccctaccccgtctgccagcatctagtttccctctaatttattttgcatcctagtggagatgcttacacattgtcaaacatatgtatatattcttttatcacacacaaatggcagcatattggacactttttgttttttgctccttctgttccttcacttaataatatcacgaacattttcggcatatcaaactttctcaacagcatcttcattgtatggatggaccctttttttatcatcaatcctcaaatagtgattatttcatttgttcccaatcttcattgtaaatagtgttgcaactgacattcttgtagctaaattttgcacatgtctataacgatttccttaggataaactccaagaagagacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattcttaattctgc

SEQ ID NO: 190658 - DNA, 843 bp, Homo sapiens
  Payload ID: 17660
  Gene Name: tetratricopeptide repeat domain 9B
  Uniprot ID: Q8N6N2
  ENST ID: ENST00000311308
  CDS Start-End: 19-738
cggcaggagtttcccacaatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggcctgcccgcccccgcccccgggcccaccagcagccccgggccggcgcgcctcagcgaggagcagcggcgcctggtggagagcacggaggtggagtgttacgactccctcacggcttgcctgctgcagtcggagctggtaaactacgagcgcgtgcgcgagtactgtctcaaggtactggagaagcagcagggcaacttcaaggccacctaccgtgccggcattgccttctaccacctgggcgactacgcacgcgcgctgcgctacctgcaggaggcccgcagccgggaacccacagacaccaatgtgctccgctacatccagctgactcagctgaagatgaatcgttgcagcctccagcgggaagacagtggggctgggtcccagactcgggatgtaattggctgaggccaatccagggggacctctctatccctcgccctcccacctcaccatgtaacttcccccgactcatgtgtttgttggtaaaacacttgtcactggtgatcataa

SEQ ID NO: 190659 - DNA, 1833 bp, Homo sapiens
  Payload ID: 17661
  Gene Name: tetratricopeptide repeat domain 9C
  ENST ID: ENST00000294161
  CDS Start-End: 652-900
tctgattgggtggtgtggcgcaatgcgcgcgaccctcaagataccaaactgtacgcatctctgaccctttcctctccttgctcctgctggtaaaccgaagcccaggagacttccaggtttgggcatctgcagagggcgaggaactggtcacggcgccgggtgggcttgcagctgtgacgcttatgtggacacctcagtgtcgctggtggttcacctcggcttcccagtttatttattgacgtcaacaaataaatgttgaataaggaagaagagttagaattgcttgaagccctctggagttttagcactagtcccgcccactcccttctacttccaggtcgggggggggcgggtccaatagaaaggcggaagccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaaggttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgttgtgaaatagggagtgtttcccttcttaatcataaaaaggcagaacattgacctgaattgcctgaattgactcctctgcagcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaaggtaagcaagaagggctttgaaatggtaaagacaaaattgtcttgctggggtggatctgtggaaagggggttttattttactttgccaatgtattattttcaataagtaatacattcacatggttgagaattcgaactgaaaaagtatacgatgaacagacctttttccactcttgtgttcttgtctccacagaaaagcagtattattagtttcatgtgtagggggttgatgcttaatcagacatacacaatatatatgttggtatgtctgtttcatatatgtatgtatgcctattctaatatataaatatatgtatatcaacgtgcttttatttataaatatacagtgtatatatttatacatatacatgaatatatatataaaataggcaggccaggtggggtggctcacatctgttatctcagcactttgggagaccaaagtgggtggatcacctgaggtcaggagtttgagaccagcctgaccaacatggagaaaccccatctctactaaaaatacaaaattagccaggcatggtggcgcatgcctgtaaacccagctactcgggaggctgaggcaggagaattgcttgaacccaggaggcggaggttgcggtgagccgagatcctgggcaacaagaacgagattctgtctcaaaaaaaaaaaaaaaaaaaaaaaa

SEQ ID NO: 190660 - DNA, 1080 bp, Homo sapiens
  Payload ID: 17661
  Gene Name: tetratricopeptide repeat domain 9C
  Uniprot ID: Q8N5M4
  ENST ID: ENST00000316461
  CDS Start-End: 311-826
agttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcagatatttggcttgagaaatataatcagaaaacata

SEQ ID NO: 190661 - DNA, 627 bp, Homo sapiens
  Payload ID: 17661
  Gene Name: tetratricopeptide repeat domain 9C
  ENST ID: ENST00000532276
  CDS Start-End: 1-210
cgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttgg

SEQ ID NO: 190662 - DNA, 858 bp, Homo sapiens
  Payload ID: 17661
  Gene Name: tetratricopeptide repeat domain 9C
  Uniprot ID: Q8N5M4
  ENST ID: ENST00000532583
  CDS Start-End: 122-637
cttcttgagaaaaagactgcagaaaggagaggtggggctttcagtagaaacaagcaaaccgcaggtccctgtggggggactctccaggaagaaggttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaagatgccaacgtccggcggtacctccagctgacacagtcagaactcagcagctaccatagaaaagagaagcagctctacctgggcatgtttggttaacaaagaagaaagatgctcctccagttgaacttaggtggaccattaaacatgcatgaaggagaaatctgagcctcagcaagagaaattaaccctatacctctgacccaggtggatttttgtttctagttctgcacaaacttcactacttagacagtctgagtctttttctgtctatccatctgtttatttctatacctttcaatacatgttattgttgcaga

SEQ ID NO: 190663 - DNA, 606 bp, Homo sapiens
  Payload ID: 17661
  Gene Name: tetratricopeptide repeat domain 9C
  ENST ID: ENST00000530625
  CDS Start-End: 186-606
ggaggcggggtcgtttctgcgggattatttttccggagcctcttctgattgggtggtgtggcgcaatgcgcgcgaccctcaagataccaaactgtacgcatctctgaccctttcctctccttgctcctgctggtaaaccgaagcccaggagacttccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacgaacgagtgagagaatatagtcagaaagtcctggaacgacagcctgataatgccaaggccttgtatcgggccggagtggcctttttccatctgcaggactatgaccaggcccgccactacctcctggctgccgtgaataggcagcctaaag

SEQ ID NO: 190664 - DNA, 7470 bp, Homo sapiens
  Payload ID: 17662
  Gene Name: tetratricopeptide repeat, ankyrin repeat and coiled-coil containing 1
  Uniprot ID: Q9C0D5
  ENST ID: ENST00000263635
  CDS Start-End: 238-5823
ccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattatagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaatggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaa

SEQ ID NO: 190665 - DNA, 4168 bp, Homo sapiens
  Payload ID: 17662
  Gene Name: tetratricopeptide repeat, ankyrin repeat and coiled-coil containing 1
  ENST ID: ENST00000454300
  CDS Start-End: 593-1981
agcggaggctttgctgtggcagctgctggagcggcggccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaat

SEQ ID NO: 190666 - DNA, 6404 bp, Homo sapiens
  Payload ID: 17663
  Gene Name: tetratricopeptide repeat, ankyrin repeat and coiled-coil containing 2
  Uniprot ID: Q9HCD6
  ENST ID: ENST00000389520
  CDS Start-End: 1-6003
atgtttcggaatagtctcaagatgctgcttactggtgggaaatcaagtcgtaaaaacaggtcaagtgatggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggttgtcagacgttaccgagtcgcccacgaggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaa

SEQ ID NO: 190667 - DNA, 11721 bp, Homo sapiens
  Payload ID: 17663
  Gene Name: tetratricopeptide repeat, ankyrin repeat and coiled-coil containing 2
  Uniprot ID: Q9HCD6
  ENST ID: ENST00000424789
  CDS Start-End: 5-5977
aaccatgtttcggaatagtctcaagatgctgcttactggtgggaaatcaagtcgtaaaaacaggtcaagtgatggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttgg

SEQ ID NO: 190668 - DNA, 7841 bp, Homo sapiens
  Payload ID: 17663
  Gene Name: tetratricopeptide repeat, ankyrin repeat and coiled-coil containing 2
  ENST ID: ENST00000583356
  CDS Start-End: 1-3764
atgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaggagccaagataggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgttctagtggccctcttcctgtaaacccagatggtgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccac

SEQ ID NO: 190669 - DNA, 456 bp, Homo sapiens
  Payload ID: 17663
  Gene Name: tetratricopeptide repeat, ankyrin repeat and coiled-coil containing 2
  ENST ID: ENST00000580068
  CDS Start-End: 1-456
ggagggagcgaggaaccaccggatcgaagacagtcaagtgtagactctcgccaaagccgctctgggcaaggtggcatctccacagaaagcgactgtgcttttgagccagactacgctgtcccgccacttccagtgagtgaaggtatgcagcacattcggattatggagggcatgtctcgctctcttccatcctcccccttactcacacatcagtctatcagtgttcggctccagcctgtgaagaagttaactgcccctctgaggaaggcaaagtttgttgagagcccacgaattccagaatccgagcttggctcaccaaccctcacttcagctcagaaactggacgtggatgcatactgccctggtgatgctgaacaggagcttggcccccctccatctgtagatgaggcagcaaacacactcatgactcgtctgggtttcctccttggagagaaa

SEQ ID NO: 190670 - DNA, 331 bp, Homo sapiens
  Payload ID: 17663
  Gene Name: tetratricopeptide repeat, ankyrin repeat and coiled-coil containing 2
  ENST ID: ENST00000580466
  CDS Start-End: 1-331
accaccggatcgaagacagtcaagtgtagactctcgccaaagccgctctgggcaaggtggcatctccacagaaagcgactgtgcttttgagccagactacgctgtcccgccacttccagtgagtgaaggtatgcagcacattcggattatggagggcatgtctcgctctcttccatcctcccccttactcacacatcagtctatcagtgttcggctccagcctgtgaagaagttaactggtgatgctgaacaggagcttggcccccctccatctgtagatgaggcagcaaacacactcatgactcgtctgggtttcctccttggagagaaa

SEQ ID NO: 190671 - DNA, 652 bp, Homo sapiens
  Payload ID: 17663
  Gene Name: tetratricopeptide repeat, ankyrin repeat and coiled-coil containing 2
  ENST ID: ENST00000583016
  CDS Start-End: 1-408
gtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacaggtacctctcatggacgttgccctcaagaatgtgttgtgtttgtgtggactctcgaatctcacccccttattttttccctggcatacatttggcagtcttctgtctcaggcttttgtaatgcagactgattcagccaaactaaacagtcaagcagttttcctctttcaatcctctttgcctgtggattctccatactctttgcaccagagtcttctttcaaacaaaactttttccctctcttgtttccaaatatttttaaaagactgaaagttaccttacaatgtgccaaaccagagcagaaaattattgtggcctgtctcctttttatgtgatccttgtagtagttaggaataaatatttctcccatcaaaa

SEQ ID NO: 190672 - DNA, 3792 bp, Homo sapiens
  Payload ID: 17663
  Gene Name: tetratricopeptide repeat, ankyrin repeat and coiled-coil containing 2
  ENST ID: ENST00000613171
  CDS Start-End: 95-3397
gctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccggaacacttctgttgttgtcactcttctgaagaaaagccaagataggttgtcagacgttccgagtcgcccacgaggtccagccacatgggcgatggccacctccaagccagacatcatgatcatcctgttgagcaagctgatggaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttc

SEQ ID NO: 190673 - DNA, 5095 bp, Homo sapiens
  Payload ID: 17664
  Gene Name: TEX13 family member C
  ENST ID: ENST00000632600
  CDS Start-End: 1-2982
atggcgatgaactttggggaccatgccagcgggttccgccatgatgatgtgatcaggttcatcaacaatgaagtcctcaggaacggcggcagcccagccttttacacggccttccgctcgcggccgtggaacgaggtagaggaccggcttcgggccattgtggccgacccgcgggtgccccgtgccattaagagggcctgtacctggagcgctttggcgctgagtgtgcaagtggctgcgaggcagcaggaggagctgctgtaccaggtttggtggctgcaagggcatgtggaggagtgccaggcgacctcctgggctctaacttcccagctgcagcagctgcgcctggagcatgaggaggtggcaacacagctgcacctcacgcaggccgccctgcagcaggtgctgaatgagcgtgatgggttatgcgggaggctgctagaagttgagagatccatgcaggtctatccgatgcctcaggattttgtacccggtccagaagccggccagtatgggcctgtggccgggactttaaatgcagaacagagtgaggcggtggccacagaggcacagggaatgccacattcggaagcccaggtagcagccccaacagctgtgtattacatgcctgaaccccagagtggcagggtccagggcatgcaacctcttctgctaatgcaggcacctcatccagtcccattccatatgccttcaccaatgggactgccatactcaacacctctaccacccccagtagtaatggaatcagcagcagcaattgcaccacagatgcctcctgcagggatctatccacctggtctttgggccacagtgggatcccaggaggagacggcccctccgtgggaccagaagtgccatggccaggatggatatcctgagaatttccagggagtatatcacccaggagataacagaagctgcaaccaaaaggaaggttctgagtgtccccaaggaatgacttcccaaggggacagcagcagccacagcctgaagaaagatccagtgatgcaagagggcacagctcccccagagtttagcaggagccacagcctggagaaaaaaccagtgatgcccaaggagatggtccccctaggggacagcaacagccacagcctgaagaaagatccagttgtgcccaaggagattgtccccataggggacagcaacagccacagcctgacgaaaaatccagttgtgcacaaggagatggtctccctgggggacagcaacagccacagcatgaagaaagatccagtgatgccccagaagatggtccccctgggggacagcaacagccacagtctgaagaaagatccaatgatgtgccaggagatggtccccctgggggacagcaacagccatagcctgaagaaagatccagtggtggcccagggcacagctcccctgatgtatagcaggaggcacagccagaagaaagtgccaatgatgcccaaggagatggtccccctgggggaaagccacagccacagcctgaagaaagatctagttgtgcccaaggagctggtccccctgggggacagcaagagtcacaggatgaagaaagatccagtgatgccccagaagatggtccccctgggggacagcagaagccacagcctgaagaaagatccagtgatgccccagaacatgatccccctggaggacagcaacagccacagcctgaagaaagatccagtgatgccccagaacatgatccccctggaggacagcaacagccacagtctgaagaaagatccaatgatgcaccaggagatggtccccctgggggacagcaacagccatagcctgaagaaagatccagtggtgccccaggacacagctcccctgatgtttagcaggagacacagcctgaagaaagtgccagtgatgcccaaggagatggtccccctgggggacagccacagcctgaagaaagatccagtgatgccccagaacatggtccccctggaggacagcaacagccatagcctgaagaaagatccagtggtgccccagggcacagctcccctgatgtttagcaggagacacagcctgaagaaagtgccagtgatgcccaaggagatggtccccctgggggacagcaacagccatagcctgaagaaagatccagtggtgccccagggcacagctcccctgatgtttagcaggagacacagcctgaagaaagtgccagtgatgcccaaggagatggtccccctgggggacagccacagcctgaagaaagatccagtgatgccccagaacatggtccccctggaggacagcaacagccatagcctgaagaaagatccagtggtgccccagggcacagctcccctgacgtttagcaggagacacagcctgaagaaagtgccagtggtgccccaggggacagcctccctggggttcagcagaatccacagcctgaagaaagagttagtgatgcccgaggagatggtccccctgggggacagcaacagccacagcatgaagaaagatctagtgatgcccaaggagatggtccccctaggggacagcaacagtcacagcctgaagaaagatccagtggtgcaccaggaggtggtctccttgggggacagcaacagccacagcctgaagaaacatccagtgattccccagggcacagcctcactgaggtttagcaagagccacagccagaaggaagatcaggagaggccccaggtaacccctctggaggatagcaagagccatggtgtgaaaaatagcccatggaaacaccagcctcaggggcagaaggtcaaggaacaaaaaaggaaaaaggcctcagaatcccagcaacagaagcctgcctcatgctccagcccagtgaattgggcctgcccatggtgtaatgccatgaattttccacggaacaaggtgtgctctaaatgcaagagagtccgtatgccagttgagaatggcagcgttgacccagcgtaaactcattgatttcaggaaggtaagtaagatggaagcactccaaagagaaaccaatttcccaggacccccttctgataaaaaagtaacttatttacttaacagaaaatttgaaaccaaaattgtagagaaaattagataaaataatccattatcctattacccaaattaagtactttttatcattgtgagtatacatacacacaaatacgtatgtatttattttcttattttattcatttatttgaataaagagagactacttctgagtataacactcagtctttaattaggggatttctcctaattgctgtcaactttttcaggtagtagattgtggttggctgatactaattggttgacaccctggagaagctgaagttatagttataaagcctgttttaaatcaaccattttctgttttttttttttctcttaacctccttttcctgaaaatgccatgtatttggctgggagcagccatgtgattttagagttccaggctatattgtattctagaaacactgcttttccttgcaagtgctatcattccttttgaaattactgcagtgttgatttttgcttatttttgttttattagttttacaggtgaagtcctgtttttgtgtcttagctccaccaaacttgcttgtttctgaagaagctgaacctgtgacattagaagatctgccaaagccacaagaagtaacacctcaattctgatggacccacacctcactgagaccccaactggctgcagtcaagaagagtgaaaggaagtcagggaagaagagatcatttgacactcattagggggaaaagggagaacaaaattgtttttgtagagttgaattttttcattggtatgggaattaacttagaaaagtttggggagttgtagtgttaaattctatagatggtagcaactttgatgaatttcacttaattcattaaatgagaagtttagggaaagagtttagggggttgtagtgttaaattctatagctgatagcaactttaattaatttcatttaattcattaaagaaatagttattgcctagtatgttttgggagctagacttgtatgttattatctagtacacacagcataatcttttattgtgaattcggttagaagataggaaagagcataatttggcatacacattagatcagggatgtattctttgccttgcatatagcgtgaccttggataaaaccaattgaagtaacatccagatccatttctgtggttctggggccaatgcgaaagagactttcatgaaaggttttttgttttgtttttgttttttttaattttttggagaaatgaggtctcattttgtcgcccaggctggagtgcagtggcatgatcatcatagctcactgcagcctcaaactcctgggctcaagtgatcctctgcctcagcctcccgagtggctgtgagccaccatgcccagcccttatgaaaggtcttgagtaaccaaactgcttgtctcattggtctcaggtgagataaatgagcagtgacaaagtttgggaaagtgtcctcacaaaaatgcaggcagagcttttctgaattcctctgctgatttcctcctttgagaaggatagctattttcctggttgcccaccagcctgcctgaaagacctggggtgtcttgaagaaaaacagtgctttggggagtgttcactacacacgctagctttcagcctcaggctgcccccatcccaagtcccttttcagtcagcagtggatgaagaacaaaatggattccaaggacaaacattgggggcaccaggttatggatggtgtttctcttgggaggataaattgggttaaaaatagagctagactggggcaagcacttttgggaataccccaggacccccacctctccctctttggtgtgttctctgcaggcttacccaaggcaactgctgcaaggcaaggaaggagccagggtggagcccaggggtggttggttagatctgccttcaatccaagctaaagatgtccttgagtttcccaatgagatcccacccagctcaccaaaatcaatgtttgtcagggattttctgggcctaactagtaataaagaatgtgcatttga

SEQ ID NO: 190674 - DNA, 4203 bp, Homo sapiens
  Payload ID: 17665
  Gene Name: TEX13 family member D
  ENST ID: ENST00000632372
  CDS Start-End: 259-2403
agcttttctctgtgacatgtcgcggagtcgccggtagggttcggtgtggcgagggggacctgcttctctctttgtgagaaccagggagtgagggaggaaggaggccaaggaggaggccaggactgagcaaggactaaagtaagactgaaaggggaggtgaggggtggactggttgtcggcagcagccggtaccggaagtggcggcagcagctgaggcgacgcaccgtgaggcagctgcttgactaggccacagccgccatggcgatgaattttggggaccatgccagcggcttccgccacaatgatgtgatcaggttcattaacaatgaagtcctcatggacggcagcggcccagccttttacgtggccttccgctcgcggccgtggaacgaggtagaggacagccttcaggccattgtggccgactctcaggtgccgcgcgccatcaagagggcctgtacctggagcgctttggctttgagcgtgcgagtggccacgaggcagcgggaggagctgctgcaccacgttcggcggctgcaaaggcatgcggaggagcgccaggcgacctcctgggctctaacgtcccagctgcagcagctgcgcctggagcatgaggtggcggcaacacagctgcacctcgcgcaggctgccctgcagcaggcgctgaatgagcgtgatgggctgtacgggaggctgctccagatcgagaggtttccccaggccgctccactggcccatgaaataatgtctgggccgcaagcagagcagaatggggctgcggcatgtcccctggctacagagcagcagagcgatatggtggccatggggacacatgctaatgcccagatgccaaccccgacagatgttctttatgtgccaggacctctgagtccctgggcccagggcatgcaaccccctctgccagtgccacatccattcccacacccaccaccattcccaatgaaattcccatccttgccacctctaccacctgctgtagtcacgggggcagaagcagcagcagtcccacttcagatgcctcctactgagatccacccaccttgcccgtggcctgcagtgggcttccaggaggagatggcccctctgtggtaccagagaagctacatccaggaggaagattccaaaatccttcaggggtcattccccttaggagacagcagaagccacagccagggagaaggttcagagaggtcccaaagaatgcccctccccggggacagtgggtgccacaacccgctgtcagagagtccccaggggacagccccactggggagcagcggatgccactcccaggaagaaggtacagaaggaccccaggggatggatcccctggggaacagagagagacaaaatcagaaagaaggtccaaagagggcccggaggatgcacaccctggtgtttcgcaggagccacaaatcagaaggtccagaggggccccaggggacggtcccccagggagacagcagaagctacagccaggaaggatgttcagatagggcccaggagatggccaccctggtgtttatcaggaggtgcaaaccagaaggtccaaagaggccccagtggactgtccccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacagaagctatagccaggaaggaagccgagagagggcccaggggatggccaccctggtgtttagcaggagctgcaaaccagaagaaggtccagagaggccccagggcactcccctgggggacagcaggagccatggtgtcagagaaagcccaaagaaatggcaacctcagaggcagaaggccaagaaaccaaaagtgaataaagtctcgggatcccagcagcaggagaagcctgcctcatttccagttccagtgaattggaaatgcccatggtgtaaagccattaatttttcatggcgtacggcctgctataaatgcaagaaagcctgtgtgccatttgagagtggaggacaaactcagtgatttcaggaaggtaagtaagaatggacacacttcaaagagaaagcaatttcctaagaccctcttctgattaaagtataacttatttacttcacagaaaaattgaaccccaaattatggagaaaattaaataaaataatttattatcccattacccaaattagccattttaaaagttgttttggatacacatacatacaaatatatatgcatttatattctcatgttattcatttacttgaacagagatggactacttttgatttctcctgattgcatttaaattttgcaggtggtggattctggatggccgatgctgattggttaataccctggagaagctgaagtcatgaagccttttcttttcctttttgtttcactccttttcctgaaaaagccatgtatgtggctgggagcagttgtgtgattttagagttagaagatatgttgaattttaggaacagtacttttccttgaaaatgctgttattcctttggaaacaaattttagaatcaccacacttccttgaaaatgctattattccttttgaaactactgcaatcttcatgttttcttcattttgctttgttggttttataggtgaggttctgtttttgtatctcagccccaccaaacttgcttgttgctgaagaagctgaacctgttccattagaagatcttccaaagccaaaagaaagtgagactgactgcagacttactggctgcagcagagaggagtaagaggaagtcagagaagaagagatgatttgacactcattgggggaaaaggaagagcagaattgttttgttagaattgaatttttccactgggacaaggaattaacttggaagagtttggggggttgtgttcaattctgtagatggtagcaactttgatgaatttcgtttagtttgttaaatagttattgtctaatatgtgttaggagctagacttataggttattatttggtgcacacatcataatccttgttgctgagttggttagaagataggagagagcataatttgggatacaaattagatcaggggtatcttctttgccttgcatgtagtgttgccttaggtaaaaccaatttaaataacatctagatccatttttgcagttttgtgggcaatgtgaaagagacttgcatgaaaggtcttgagtaaccaaactgctagtctcattggtttgcaggtgagacaaataagcagtggcaaagttcaggaaagtggtcttacagaagtgcaggcagggcttttctgattgtctgctgatttcctcctttgagagggacagatattttcctggctgccagtaagcctgcctgaaagaccactggggtgtcttgaagaaagacagtgctctgaggagtattcactacacactccagccctcagcctcgggctgcccccattccaagtccctttctagtcaataggtggatgaagaacaaaatggatttcaaggacagacagacagacataagggctgtgggctatggatggtgtttctcttgagaggactaattgggttaaaaataaaactggacaggggcgagcactcttgggaatgcccctggacccttcctctttggcgtgttctctgcaggctcccccaaggcagctgctgcaaggcaaggagggatccagggtagagctcagggatggtgggttagatctgcctccagtccaagctaaagatgtcttcaagtttccctgtaagatcccgcccagctcaccaaaatcaacctttgtcaggggttttctgatcctaactagtaataaagagtgtgcactgg

SEQ ID NO: 190675 - DNA, 5337 bp, Homo sapiens
  Payload ID: 17666
  Gene Name: TGFB1-induced anti-apoptotic factor 1
  Uniprot ID: O95411
  ENST ID: ENST00000359450
  CDS Start-End: 4659-5006
ctgctgagtgacagcctccccctggctctcctgcctcccccagctcttctccctgtggggagggagatctagcagttaggccctttatgcccacacccccaccatggaagaagggcagagcctgactcattggaatcccattgttgccagtttctctggtgcgtggtgacattttagatcaccctgcttatgtgaagctgtttttggcatgctgccctcccagggcaagcttgctgcttcccaggaggtatgtcccccgagtgcagcccctggggcacagacatttgtctcccagatgcatgaactaacacacctgtcgcatgcttgtgctgtggagcggctggacacctaggctgactttgaatggattataccaaacggactgatgtaagaccttttaaggaatggagcaagtggaatggctcagccctgctctgtcacttcccccatgcagcagatggttactgggtgctctgggaggaacaggaagcatctctgttgtaccaaggaaccagtgttggctccatagtaagacaagagtcagccgagcatggttattcacacctgtaatcccagcactttgggaggctgaggcagacagatcacctgaggttaggagttgagaccagcctggccaagatggtgaaaccccgtctctactaaaaatacaaaaattagctgggcgtggtggcgcatgcctatagtcccagctacttgggaggcagaggcaggagaatcgcttgaacccgggaggctcggaggttgcaatgaaccgagatcgcaccactgcactccagcctgggctacagagcgagactccatctcaaaaaatatatatatatatgagtcaatatttgatcaggcatctcagccttcctcttagcagccctgctaagtgccccacacccctagggcaggaagtcagctgatggacctgggagaggggtttggaaagcaaagagggccaggccttgttgcacactgcgcctctacccccagatggacatgggcctaaagctgggccatcccacactgactggcaactggcagatttcagaccccaatgccctcagcccaccatcacccttgaccccacaaccagcaataacaaaaagaccaaaagcctgtttcttccaccagccaccagcgcagttcctcttttccaccaggaaagctggagtagtcctgacgccatatataccacccgctccaaggaggattggattcactgttggtagagtggccatcaagccagaacctagccaaccaacacggagccagagggagaaggccaggggagggaggacctcagtggtgctcagcatcaactggctttggggtgggggcatgggatggagcagtcacttagcttcccatctggtgatgaggaccagcaagaatttgcaacaggaacgcagcttccatagcaaagtcaaggggaggggagctgccgccctgggcttgcctggcaggaattagcttatgtaccaaattgtttgtgacagtgctgagcaggagacgctggcttgtgaggaggaaggcttttttaaacaatttggttaaaatgttcaaattgccagctctgactcttgccctggagaggagggcagcggcctgctgttgactccctgatggctggagcagtggaagccactaagaatggctaaagatcacccaagctacgggcaagggcaatctcgtgggtccgcagcccaaggcagagagagacatggagtttaccacctccccggcagctcctgccactgcccagcgtcttgatgaaacagtatggaaacacggctgtcatttatccaggtgtctgcctagcaggtacaggaatgtgggcttggggactggagcccccaccttaaaaagaggtgaggcaatggaaaggaccagaggggccctgattcagcaatttacagtgccttggagctcgccagcagcacctcatttgcatctggattccagccctggcatctgcctcgccccgctctgctcacaaagtaaccccactgtctttccacaaagccaggcactccttagcctaacggcagatcctagccctgagtgcccagaaattctatgtaaagaatgagaaccaaaccaggctcccactaatttagaattcaaacaaccccaaagctaaaataaccccaatttttttctatattgcatagtcatcagtgagctttataattttgtcctagaaacccccccagagtccctaagtgcctttggcctatcaaagtaagactcatttatgttcagtctagtttgtgttaaatgtgttttgtgctatcctgattcctttaaaaatggtaattcattcatgagaaatacgataactattaaccagactgccccattcctgaaccattttgcataattgaacatgtattctatcagcctcttcctttcccccagggatagagaccgacctttctttacataacccctgggcacttgcccaagccagcaggagaattcaggtttggtcctttttttttttttttttttttaatctcaggtcaaccaatcgagtggcggggtgaagtcgtccaaagtctttgaggtctaagagtcccagattcaagtttacatactggctgtgtggccttggggaagatcctttcatctctttggactggcttcctcgtaatatttcatagggttattgtgaagagtaagatagcctatctcacatgcctaggccgtgtcttacacataggagtactcagtgaccaaatcttgccctctgcatctctcactgccaccttgggaaaagctaagaaggtggttcttgccgcagaacgctgactcctcctattttggtttggggatagaactttaaaagggctagtaaacaaaggtcccttttcagcttaagtcagaattataggcagcagggaacatggaactcctgcttgcccaagttggaactctaggatctggaggcagggctgcagctccagggaccacgccgagtgtggggcatcagtaggagaggagccacactgggctgtgttttctccaatggtgttgaaacgagagtgcacttgaactgacggaggcagtggaggcaggaggagtacgggaaaggtggccccaaggctttgggagaaagaaaagagaaggtgaatggagctgtgagatgaggtcccctcttccctgttcagtgctgtgatcctgctccatcagggggaagaggcctcttcacatctgggatagctggaggcctccagagccagaggcctgatgaagactctgagttatgttattgtaccaagaaaggggcttttccccttgggccatcctaaaacaggtcttcccagcctctccttcctgagcctccatttcttgttagtagatgatggcatggtcaaagctgaaaattctcacaggcctcagggagccatcattaggggaaagggttcagatctgggagtatttgacagggaaagcgcctcctcctcagaaggaatctttttaggaatcactcgcctaagagagcccctaccctagacaagttgtactcaccagacctccagtctccaagccaatgtggttcacggactgcctgcttcagagccttctggggaaggactgaaaatgcagaattactgggttgtacccaaaagccagcgattcaaggtttctaagaggaagggcccaggaacctgcatcagattcttatgcacgcttgagtccgagactcactgctctcagcatccctttcctcggagctttaaaagcttccagagtctccttcctcttagcattttgagtatcttctaagtaagccaaggaaggtttttacttaacaatgtttggcttttggggagtgctctgacgcagctttgtgggcctccagaaccaaaggcgtgcgtgcttaatggtaggagtgtcatttgtccctaaccttattcctcggtccctgcagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 190676 - DNA, 3237 bp, Homo sapiens
  Payload ID: 17667
  Gene Name: TGF-beta activated kinase 1/MAP3K7 binding protein 1
  Uniprot ID: Q15750
  ENST ID: ENST00000216160
  CDS Start-End: 63-1577
ctctagccgccccactcgctgctctgcggggaggcgggcgctcccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggagaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtatagaaaccgcagtgggcctgcaagccgcccgagcctccccagcagcctcctacagagcaggaagaggcgccctgtgaaccctgagtgttgcaggcccagcagaccctgctgtcccaagcccacccctcctcccaccatcacctccctcacctcgggacagtagccctccacttctccagcctctcagccctgtgctcctgcatccagagtggaacccaggctggtgtccgcatctgtccctgggccccacccctggacctgccttggttgtgtcatctgttgtaaacgttcaggaggaccagggcagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcattttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagtggaaaatggttccaggagggaagaggttctttgagacacagtaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggccaagccacacaatcagtggggcagccagagctcagacctgagccattttgtcagtatccaggaccccccggattctccacgccctccccatctcccagtctccctgccccccatgccccagaccggcccaccagggactagccgctgtcgcacagcctctggggtgcttggtctctgcgaagtcaaaggcctgacagctctgtggcctgggaatccattttcctgcggcagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattctcttccaagaatgcctctgtggtgctgtttggtctctagaaacagggtcacttttttaatgtagtaaagaagtaataaatggtggcattacacattgtgatattaa

SEQ ID NO: 190677 - DNA, 1660 bp, Homo sapiens
  Payload ID: 17667
  Gene Name: TGF-beta activated kinase 1/MAP3K7 binding protein 1
  Uniprot ID: Q15750
  ENST ID: ENST00000331454
  CDS Start-End: 20-1408
ccgcaggggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaagacccttccaggcctgcaagcgatttgacagccatccctcagtgccaactaaacctcctgggcagcctgaccccagggtaggaaggaagcgcctacaccaaggggccctctgggagctgagatcatcctggggttttgtcgcctggtctgacttgtgcactgggatcttctcgtgccaggccaggccccgccccctccccgggactgggcagaccccctccctcatgcatctgtgtccactgaggcttccctcacctagaatggcccatccttcaggacccagctcactctcatcttctttccagggacttatcccccaaggctgtcctctgt

SEQ ID NO: 190678 - DNA, 4553 bp, Homo sapiens
  Payload ID: 17668
  Gene Name: TGF-beta activated kinase 1/MAP3K7 binding protein 2
  Uniprot ID: Q9NYJ8
  ENST ID: ENST00000367456
  CDS Start-End: 578-2659
gaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtgga

SEQ ID NO: 190679 - DNA, 4199 bp, Homo sapiens
  Payload ID: 17668
  Gene Name: TGF-beta activated kinase 1/MAP3K7 binding protein 2
  Uniprot ID: Q9NYJ8
  ENST ID: ENST00000470466
  CDS Start-End: 111-1721
tttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagatatttgaagaataagtaattcttggctgggcatggtggctcacgcctgtaattccagtgctttgggaggccaagatgggaggatcatttgagcccaggagtttgagaccagctggggcaacatatggagactccgtctctacagaaggttttgaaattatgcaggcatggtggcacacacctgtagtcccagttactcagtagactgagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttgga

SEQ ID NO: 190680 - DNA, 4240 bp, Homo sapiens
  Payload ID: 17668
  Gene Name: TGF-beta activated kinase 1/MAP3K7 binding protein 2
  Uniprot ID: Q9NYJ8
  ENST ID: ENST00000538427
  CDS Start-End: 267-2348
ttactctagtttctcttctgctttcaaggctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 190681 - DNA, 677 bp, Homo sapiens
  Payload ID: 17668
  Gene Name: TGF-beta activated kinase 1/MAP3K7 binding protein 2
  ENST ID: ENST00000606797
  CDS Start-End: 578-677
gaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgccagagggaacaggcctgatg

SEQ ID NO: 190682 - DNA, 648 bp, Homo sapiens
  Payload ID: 17668
  Gene Name: TGF-beta activated kinase 1/MAP3K7 binding protein 2
  ENST ID: ENST00000606202
  CDS Start-End: 257-648
agtgaggtgaactccttcagggccacaggctgtaaagatctaaacaccatctgatccagtttcaatatgactgcctggatgaagaaggatttgagactaagtttattcctccaaagcaaaccaactgagaatgcagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtact

SEQ ID NO: 190683 - DNA, 805 bp, Homo sapiens
  Payload ID: 17669
  Gene Name: TGF-beta activated kinase 1/MAP3K7 binding protein 3
  ENST ID: ENST00000288422
  CDS Start-End: 664-805
cccgacggaagccctgaagccagagcttgcttgccaagctctcgctcagaccggatctaggaaatacgaggcgggcctcggtgggagggacgcactgagggaggagggaggaaagggggcggcggcggcggcggcggctcacaccggatcccggccctgcacggcgcgtaccctgggggttcgggcggggaagcggcgccggcccggaccccccgcgggagtaggcgacgggcgtgagggcgaggcggcggcggcggcggccagagagcagcagccgcctggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttccc

SEQ ID NO: 190684 - DNA, 6255 bp, Homo sapiens
  Payload ID: 17669
  Gene Name: TGF-beta activated kinase 1/MAP3K7 binding protein 3
  Uniprot ID: Q8N5C8
  ENST ID: ENST00000378930
  CDS Start-End: 133-2271
tgtaactagacttaaccatactttttttttttttttaaatagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccacggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggaaactttgatccaaaagccatgaataatttttatgacaacatagaacctggcccagttgtaccacccaagccatctaaaaaagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacact

SEQ ID NO: 190685 - DNA, 3698 bp, Homo sapiens
  Payload ID: 17669
  Gene Name: TGF-beta activated kinase 1/MAP3K7 binding protein 3
  Uniprot ID: Q8N5C8
  ENST ID: ENST00000378932
  CDS Start-End: 548-2602
cacatgaccattggctggagcccagttgaccaagaaggaagccagagaaagccacacattcgggcgagcaaggatcacaaggagacacatctgagcctgatatagaggattgcacatcagcacatcattcagagatcctggactttgagatgtatgtagtaacaggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccacggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaa

SEQ ID NO: 190686 - DNA, 6671 bp, Homo sapiens
  Payload ID: 17669
  Gene Name: TGF-beta activated kinase 1/MAP3K7 binding protein 3
  Uniprot ID: Q8N5C8
  ENST ID: ENST00000378933
  CDS Start-End: 548-2686
cacatgaccattggctggagcccagttgaccaagaaggaagccagagaaagccacacattcgggcgagcaaggatcacaaggagacacatctgagcctgatatagaggattgcacatcagcacatcattcagagatcctggactttgagatgtatgtagtaacaggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccacggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggaaactttgatccaaaagccatgaataatttttatgacaacatagaacctggcccagttgtaccacccaagccatctaaaaaagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacacta

SEQ ID NO: 190687 - DNA, 7987 bp, Homo sapiens
  Payload ID: 17669
  Gene Name: TGF-beta activated kinase 1/MAP3K7 binding protein 3
  ENST ID: ENST00000467136
  CDS Start-End: 384-2210
ggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccacggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggtatagacttgattatttggtaaaccataagtaatagtgtggtattttaagctgcttaaatagcaataactttggttttgtagatttaagagacagtttttatccgtaagattacaatcctgggaaagagatccccctgtcccatggtcatggatcagatttggggatgaaaaaatagttttacttcggcagtttcatcaagttcttatcatttagactgttctatgttgttactttgcatttatcctctttttgtcatttactgtgaatattttataaattgatgggttttaattctaaaacttagtagagttcatattatgtgatagacatctaaaatatctgtaaaaagggatcccaaatcagagtatcagatttctcagttttaaaataaactctatatatgttatttttcatgttatgttatgtgaaaacattcaactataatcatagttttagttttttggatttttttacagaagtatactacagcagaagctctcttaaactttcatttacccaactcaccagattagagatggtcttcattttctgtggaaaatatactgactgatgtccacagctgctgcatacttttgactagtaggctgcattctggtaggcccatgaatattgctcccatcggttgaattgtctgcttaccaagagttgattctgtccccaaacctgtttatgccagttattgtatttctgcaatttaatgtttcataaactgacatgaaggagaaagccgctctttctatgaaagccaaaggcaaatcactcaaaaaatagggattgtgaattagatatgggtgaaaacaactgaaaaaagtctaaaaggattctgtactcaaattgcattataagtgttcttaatatctttcttgctccattctaaagcaatcaaaattatagatgagggttcagcaaactagggcctgttgcctgtttctgtgaataaaagttttagtggagcgatagccatgcccatttgtttacatattgcctatggttgcctttgtgcttcaacagcacagttgactacttgcaacagagactctatcacaggtccacaaagtctaaaatattatctggcccttgacagaaaaggtttgccaacctctgctgtaggtcatcatgggtgtggtttatgtaagaaatacaatatggaaccccagccaacagacacgtaaaaattaggtctttatctaactaactttaaaatatagctatatacaagtgttttgttacgttaaagttgacgtgtaatttttcttaattctgtgtattaatcagctttcctgccccccatcccccacacttaacttttcttgattatggcagctaagactttctacagtgttttaagagtatataataaaatatctcactgccatttttaggcaagattaaacaaacagtaggctgggcacaatggctcatgcctgtattcccagcagtttgggaggccaaggtgagaggatcacttgagcctaagagttagagaccagcctgggcaacatagggagaccccatccctacaaataattttttaaaaattagctaggtgtggtggtgtgtgcctgtgatcccagctacgtgggaggctaaggcaggaggatcacctgagcccaggaggtcaaggctgcagtgagccgtgatcacaccgctgcactctagcctaggcaacagaaggagactcggtctaaaaaacaaagagcgagagattaaagattagtggcaggtgaacccaaaagacacggcattatctgaacaacagacagaagcaaatttgaatgtgagaattgagcaatctagtcaggtacccttaaagtcattttcagaagcctagtcactctatagcccactaacttgaagcaatcaaagaattactatgcatgatgtaggggttacataaactattgctactatattttagaagattgcatcaatttcttttacttgtgtggtctttggagcaaaacaaacagtaaaacatttggttaggatacttatagtaagccttttgtgatctagaaattagaacatgagctgtaacaagtaattgaagaaatacatatgcagcttcttaaagcataaaaagattcaattaatacatcaaatagcactgtggcttttatgagctatcacagcaattattttcagaaaattatcttaaaacagcatattcaagtggataaaacatttgtgaaagggcctgcaagggaaaccactattaaggttttataagcaaagagctgtgttttttgtctgcattggacaatgagctctttgggatacttaggcatttctaaatctcttttcataacgaatctaaatgtatccattttatactaaattctactcttccacactgcagaaaactttttatactgagtttccaatctaaacttttaagctagggaaggaatctaaacctttttcggtggtgacggggggaggcaggggaataagcatttagaatagatgcaaatcagtgcatgacttgatgaaaaccagcttttttgtgatttttggtaaggaaaacttgttgggaaaaaaaaaagtagatctggaaatgaagagatttaatatatttaaactatcagtattagtaccatacagcatcttctataaataagtatggctacagttaactgtaatcgtttagaacaagcagagcacagtgataggttcacagaagtgaaggcaggacccaaaaccaaccttggaggagacacagcaggagatgtggctgaaatacagacactagaccagggaatgaacatttgaagacagacaggtgaaaattttgtggcaagacaaaattctcaggtattgttctatctattctgaaattggcaccttttatcattgataaatctgtaggaaacatttaacacttagtgtaagattctccttttcttgaaaataagaatacataaactgctgatgttatttcacatttattgaggttgcttagtagtctcaaaatataacttgattaatccttgtaaatgtttatatttggctttttctgtagttcaatttataatgaatttttaaggtaaattatgataaatatgaaagtaagctttcattatttaagtgttctttctcacagtttgttcattaaaaatcaaaacaagcagaaagagaaaacagttcaaccatcctttcatttctcttcttcatttatctccccaaatgccccacatgcctaatcctgcctaaggagactagccttacaattagaaaaatattcctttaagtgtaatacattgtagacatacatctgtgtagtggttttcttgggtcttttctcacagcgatgaaaacacaatttcattgggaggacagaattatgtaatgaattttgaaatcctggaaaacatttttcccttcttatgtgttttatttacatattttctttaaaaaaaaatcaaataacaggaaaaaagagttcttaaatgcctgatgaatttactttctttataggaaactttgatccaaaagccatgaataatttttatgacaacatagaacctggcccagttgtaccacccaagccatctaaaaaagggtcccgctctgtcgcccaggctggagtgcagtggcatgatcatagctcattgcagcctcgacctcccaggctcaagccatcctcctgcctcagccacctgagtagctgggactacagacgcacaccaccacgcccggctaatttgtgtattttttgtggagacagggtttcgccatgttgcccgggctggtctcaaactcctgggctgaagcgatcctgctgccttggcctcccaaagtgctgcgattacaggcataagtcactgttcctggtctgaaagactcttttctatgactcatttaactcaaacacaatttgcaaaaactgatagtcccttagagttagttataatgggatttcggttaaaatttcttaaatatgtattgaatgctcaatgcgtagctcaattatgtagatagatgcttgctgttacacagggaaaacatgactcctaccccaagcagtttaatattctacatatgtacacttctaataaaaaagagactaggaagccatctcagtcatcttcactataaatgaatttctattttagaaatttagtagttgtaattctataataatatatattattggtgaaagtataaatggttctattatatgccaaattgtctttaacccgttttttatcttcttctgttaaaacttagaaacagtagaacttgattaaattctataattttttggtaagcctttcatcacaaatttataaaagctattcagttttctccataaaatcaagtttgttttccattaagcacttgcagattctcatattgtatttgaaactaaatcggcgttttctaaaagtacatatagtttagcacagattggcctgctattgcaggccactcaaatacaaaaagaaaaaagataaaccagtaaaacacaaattactggtagaataggtttattggttcgaataaataaatgtcttggagttattacagatatataccagaaatccaagtgtaattaatatagtttatctgaattctaagtgtgataattaaagaatgtgagggagacagaaggaaagagagagaaagagacagagaaacaaaccttttttggattggactttgtagttaagcaatacagtgtgtacgtgctcttcagcgggcttagaatgtctcccaacccttattagtaactcataacagtggtagattggactttgtagttaaacaatacagtgtgtatgtgtgctcttcagtgggcttagacagcttccccaaccttcatcagtaagcaagcaagcacactgaccttggtgtcccacgatctgagcactggtcctggtcatcttggccacctgaccttgttcaaactcaatctgagcaccatagagggacaatccagccaaatactccaaaggttgtaagagttagtgagataaggtatgtgactcgacagaagtactttgcaaatctaagaaacagaactttaccttattctttggagccttaaggagacattcactctgcttttgtttactcagacaatggagtatttaagtacctgagcaccatgctttggattctggagcagtgatttccaaagatgagttgtactgtgggctcagaattcattagaaaatgcaagatctttctttggttcctaagggcaaataatataaaggctgccatttttcatttttaatccaaagggttgcttactaataaactataaatttatagaaacaattttctagcaagatattaggatgcctacagttcttgtctgtgttgcaaagtgtctgctgggcttctgcacacataggtaattggaattcaggaaatgatttgggagcacgtggttgtcagtatatactattatatcgagttggttctgatttttcaagtactgctatttttaaaaaatccaccagacacagtggctcctgcctgtaataccaacactttgggaggctgaggtgggaggatcacttgaggccaggagtttgagaccagcctgggcaacatagcgagagaccctgtctctacaaaaaataaaatttaaaaaattagctgggcgtggtagtggcatgcacctgtagtcttggatacttgggaggctgaggcaggaggatcacttgagcccaggagatcaaggctgcagtgagccattattgtgccactgtactccagcctggacagcagaacaagaccctgtctcaaaaaaaacaaaaacaaa

SEQ ID NO: 190688 - DNA, 1980 bp, Homo sapiens
  Payload ID: 17670
  Gene Name: TGFB-induced factor homeobox 1
  Uniprot ID: Q15583
  ENST ID: ENST00000330513
  CDS Start-End: 304-1509
gggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 190689 - DNA, 2076 bp, Homo sapiens
  Payload ID: 17670
  Gene Name: TGFB-induced factor homeobox 1
  Uniprot ID: Q15583
  ENST ID: ENST00000343820
  CDS Start-End: 787-1605
atcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 190690 - DNA, 1088 bp, Homo sapiens
  Payload ID: 17670
  Gene Name: TGFB-induced factor homeobox 1
  Uniprot ID: Q15583
  ENST ID: ENST00000345133
  CDS Start-End: 147-905
tttctgtgggaggccctgaaacgcgcggagcttccctctgcctccaggctttcccagcgagagtgaaattaaacttgaaactcggatcaactggcagtcgttgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagcta

SEQ ID NO: 190691 - DNA, 1352 bp, Homo sapiens
  Payload ID: 17670
  Gene Name: TGFB-induced factor homeobox 1
  Uniprot ID: Q15583
  ENST ID: ENST00000400167
  CDS Start-End: 128-886
cacaacatttccttgtatgtggatagcgtgaaagaagcttgtgatcctgcccccaccctccccaccgccacattttttaaagtgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 190692 - DNA, 1585 bp, Homo sapiens
  Payload ID: 17670
  Gene Name: TGFB-induced factor homeobox 1
  Uniprot ID: Q15583
  ENST ID: ENST00000407501
  CDS Start-End: 358-1176
ggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaa

SEQ ID NO: 190693 - DNA, 1689 bp, Homo sapiens
  Payload ID: 17670
  Gene Name: TGFB-induced factor homeobox 1
  Uniprot ID: Q15583
  ENST ID: ENST00000405385
  CDS Start-End: 465-1223
gaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 190694 - DNA, 1670 bp, Homo sapiens
  Payload ID: 17670
  Gene Name: TGFB-induced factor homeobox 1
  Uniprot ID: Q15583
  ENST ID: ENST00000401449
  CDS Start-End: 446-1204
gactcccgcccgcatctcggggtgggaagggttcaggaaacacagaccagcttatcttaaggaagcctggtcgggaatctttcaaaaacacatctgttacaagggggaaagacacctccaggacaacagtgatttgcctcagcggggcaaaggccaggcctgacggaagagcccagccttcgccgagggccgcagggagccagagactcgagcctgcggttccagccccgccgcggttccggccccgccgcgatcccgaggcctgcgcatgctcggtgctgcgcggggctccctccttaccgcaggagctcctcatcgagaaacccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 190695 - DNA, 564 bp, Homo sapiens
  Payload ID: 17670
  Gene Name: TGFB-induced factor homeobox 1
  ENST ID: ENST00000551333
  CDS Start-End: 152-564
atgccattgtttgtaattcatttctgtttttaagattctagattgtctacaagcaaaagaatgtatttctttagtcattcggagtagcctgctgtagtttttgaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcc

SEQ ID NO: 190696 - DNA, 1089 bp, Homo sapiens
  Payload ID: 17670
  Gene Name: TGFB-induced factor homeobox 1
  ENST ID: ENST00000551402
  CDS Start-End: 314-712
gacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgt

SEQ ID NO: 190697 - DNA, 1536 bp, Homo sapiens
  Payload ID: 17670
  Gene Name: TGFB-induced factor homeobox 1
  Uniprot ID: Q15583
  ENST ID: ENST00000548489
  CDS Start-End: 312-1070
agaaaataaaatattagccgagtgtggcgtcacacgcctgtagtcctatctacttgggaggctgagacaggaggatctcttgagctcaggagttcaagactgcagtgagctgtgatggcgtcactgcactccagcctgggcgacaaaacgaggctctgtccccaaacaccaaaaacctcacaaggctcttccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 190698 - DNA, 801 bp, Homo sapiens
  Payload ID: 17670
  Gene Name: TGFB-induced factor homeobox 1
  ENST ID: ENST00000549780
  CDS Start-End: 144-801
tggcttgtccccaggaccgcgctccccccgagccgttttaggtgtgtgttctcttctgtcccgagcagtcagcaaaccacagaagaaaaaaatcgtaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactc

SEQ ID NO: 190699 - DNA, 554 bp, Homo sapiens
  Payload ID: 17670
  Gene Name: TGFB-induced factor homeobox 1
  ENST ID: ENST00000546979
  CDS Start-End: 201-554
gccgccgcgctcggtccagtcttcccggctggaagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttct

SEQ ID NO: 190700 - DNA, 1267 bp, Homo sapiens
  Payload ID: 17670
  Gene Name: TGFB-induced factor homeobox 1
  ENST ID: ENST00000552383
  CDS Start-End: 765-1267
ctctcgctcttgccctctggggacccaaaaggcccctggtcctcaagtcagccacctctgtgtcttcctccatccaaaagacctgcaggagcttctgagcctggtgacacttgctggggaccaagaccatcctactccgccccagccacgctgcatgacctcatctcagcccaaaaacagacattgggaacatctgaccatccatcccgttcccccgctctttttggctacctgcagtgaccccagcagcaggggcgggagttgcctgccctcttccagcctggaagagcatctgtcctacgctcctccttccgggagtgactcccgcccgcatctcggggtgggaagggttcaggaaacacagaccagcttatcttaaggaagcctggtcgggaatctttcaaaaacacatctgttacaagggggaaagacacctccaggacaacagtgatttgcctcagcggggcaaaggccaggcctgacggaagagcccagccttcgccgagggccgcagggagccagagactcgagcctgcggttccagccccgccgcggttccggccccgccgcgatcccgaggcctgcgcatgctcggtgctgcgcggggctccctccttaccgcaggagctcctcatcgagaaacccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctct

SEQ ID NO: 190701 - DNA, 2214 bp, Homo sapiens
  Payload ID: 17670
  Gene Name: TGFB-induced factor homeobox 1
  Uniprot ID: Q15583
  ENST ID: ENST00000472042
  CDS Start-End: 985-1743
aaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 190702 - DNA, 706 bp, Homo sapiens
  Payload ID: 17670
  Gene Name: TGFB-induced factor homeobox 1
  ENST ID: ENST00000550958
  CDS Start-End: 314-706
taagaaaataaaatattagccgagtgtggcgtcacacgcctgtagtcctatctacttgggaggctgagacaggaggatctcttgagctcaggagttcaagactgcagtgagctgtgatggcgtcactgcactccagcctgggcgacaaaacgaggctctgtccccaaacaccaaaaacctcacaaggctcttccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaacc

SEQ ID NO: 190703 - DNA, 820 bp, Homo sapiens
  Payload ID: 17670
  Gene Name: TGFB-induced factor homeobox 1
  ENST ID: ENST00000549546
  CDS Start-End: 84-820
cagcgagagtgaaattaaacttgaaactcggatcaactggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagct

SEQ ID NO: 190704 - DNA, 526 bp, Homo sapiens
  Payload ID: 17670
  Gene Name: TGFB-induced factor homeobox 1
  ENST ID: ENST00000549468
  CDS Start-End: 128-526
cacaacatttccttgtatgtggatagcgtgaaagaagcttgtgatcctgcccccaccctccccaccgccacattttttaaagtgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctaggg

SEQ ID NO: 190705 - DNA, 563 bp, Homo sapiens
  Payload ID: 17670
  Gene Name: TGFB-induced factor homeobox 1
  ENST ID: ENST00000549253
  CDS Start-End: 289-563
agcatgtgagcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccg

SEQ ID NO: 190706 - DNA, 990 bp, Homo sapiens
  Payload ID: 17670
  Gene Name: TGFB-induced factor homeobox 1
  Uniprot ID: Q15583
  ENST ID: ENST00000551541
  CDS Start-End: 228-986
acattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaaccca

SEQ ID NO: 190707 - DNA, 729 bp, Homo sapiens
  Payload ID: 17670
  Gene Name: TGFB-induced factor homeobox 1
  ENST ID: ENST00000577543
  CDS Start-End: 279-533
caaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtca

SEQ ID NO: 190708 - DNA, 3030 bp, Homo sapiens
  Payload ID: 17670
  Gene Name: TGFB-induced factor homeobox 1
  Uniprot ID: Q15583
  ENST ID: ENST00000618001
  CDS Start-End: 132-992
cagcgttggctggggggaggcagtgggggtgcatctacgggagcggttgggctgtaagctttcgctacatcacagaattgtgccagtgtttctctttggagtgcctcgccagctttaacaaccgtttggatatgacttgctcgggcaaaagttgtgcattggcccgatcaagcctgacttctagccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacggtggggttctgtctatggtgggattgtcagtttattaggtgagtattttccaaggtctcagtttgtgaaaaaatggtgctatgtacaagtggagtttgttgggatagacaatcacttacaaagcccagatggccagaagggaattggtgttgctcctttcacttgtatggttgagcagatttgtcacatgccacaaaaccattctttgtagtcatgcttagtatgagcttgctttgttgttacggtcatgttctttccagccctgccccagctatgaattgtctaagtgtgagggagcatcagagcttcagtattgtttaaagaatgtagaaaaatacaaatttgtctaattttgaaactattttagaaagtccctactgtagaaagagctaaactcaaagactttccttgtaagtgaaagaaaaaaactgctgatgattaccaagaggcgtaagaaaattaggtgagggaatgttgtgctctagcctgtggggtgcagcttcgtagggcacatcagcttagaatggtctggcctcacctcagagagtcacagaaatagacaaaaacccaaaaagtactagtaaagtaaatacaaggaacaaaataaacattaataaaaatgaatgacgcaaaggtgatccagaatcattacttgctccaacagctagatcaaaggctgaacattttgctttagtatagatgagggaaatgagcaagtcctaaaaggtttgccctgttacggtgtttcatcactcatactggaaggagaaggaaaggagccatatgactcatttaaaagaaaaactgtaagtcaccttaaattccctatgttttacttcattttttccctattgaggttgttacaggtcatggttgataatagttggtgttgaatgaatgtaatccattatttaaaaacaggtacatttaagtgaaaagataaatgtaaaaagctgttcatatcaaagccaaatagaaatgatttttatgcttataatttacatggtgcaatatatctttttaatttgtttactttt

SEQ ID NO: 190709 - DNA, 3406 bp, Homo sapiens
  Payload ID: 17671
  Gene Name: TGFB-induced factor homeobox 2
  Uniprot ID: Q9GZN2
  ENST ID: ENST00000373872
  CDS Start-End: 174-887
gtgctttccagccgcgagctgtcaggccgagtgtcaggccgggcaggtacgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaa

SEQ ID NO: 190710 - DNA, 3432 bp, Homo sapiens
  Payload ID: 17671
  Gene Name: TGFB-induced factor homeobox 2
  Uniprot ID: Q9GZN2
  ENST ID: ENST00000373874
  CDS Start-End: 200-913
gcggggggtgggcgcagctcgtcgcgctccgcacaaagtttgttttctccctccgggcgggtgggggagggcgcagagggcgcggggggaggagaggggatctgacgtcaggccgcgaggtgctttccagccgcgagctgtcaggccgagtgtcaggccgggcaggtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagcagaaa

SEQ ID NO: 190711 - DNA, 638 bp, Homo sapiens
  Payload ID: 17671
  Gene Name: TGFB-induced factor homeobox 2
  ENST ID: ENST00000558028
  CDS Start-End: 117-638
cccgcgccccgaagagtcggccagccccgaactgccggagtaggggtgggaaccaaactttttcctgccccgggacagacacgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagc

SEQ ID NO: 190712 - DNA, 923 bp, Homo sapiens
  Payload ID: 17671
  Gene Name: TGFB-induced factor homeobox 2
  Uniprot ID: Q9GZN2
  ENST ID: ENST00000560025
  CDS Start-End: 212-923
ggatggcgggcccgcgcgggagctggtgcgcggagtcggcccggggtgtggggactgtggggtgcaagcgccccgagcgccggacgattcctcgccgacccaggagccatgtgctccgactcggtctgggccgcgggggaggttgcgcgctttgtctgaactgctgggaatgcgggcgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagt

SEQ ID NO: 190713 - DNA, 785 bp, Homo sapiens
  Payload ID: 17671
  Gene Name: TGFB-induced factor homeobox 2
  ENST ID: ENST00000558465
  CDS Start-End: 1-108
aagctgagcctttctggacagaccaacctgtcagtgctgcaaaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagata

SEQ ID NO: 190714 - DNA, 797 bp, Homo sapiens
  Payload ID: 17671
  Gene Name: TGFB-induced factor homeobox 2
  ENST ID: ENST00000561398
  CDS Start-End: 1-277
cctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattg

SEQ ID NO: 190715 - DNA, 659 bp, Homo sapiens
  Payload ID: 17671
  Gene Name: TGFB-induced factor homeobox 2
  ENST ID: ENST00000557885
  CDS Start-End: 1-335
aaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcggggagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaa

SEQ ID NO: 190716 - DNA, 3344 bp, Homo sapiens
  Payload ID: 17671
  Gene Name: TGFB-induced factor homeobox 2
  Uniprot ID: Q9GZN2
  ENST ID: ENST00000611732
  CDS Start-End: 117-830
cccgcgccccgaagagtcggccagccccgaactgccggagtaggggtgggaaccaaactttttcctgccccgggacagacacgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaaatatgtaactggttcatcaatgcccggcggcggcttctcccagacatgcttcggaaggatggcaaagaccctaatcagtttaccatttcccgccgcgggggtaaggcctcagatgtggccctcccccgtggcagcagcccctcagtgctggctgtgtctgtcccagcccccaccaatgtgctctccctgtctgtgtgctccatgccgcttcactcaggccagggggaaaagccagcagcccctttcccacgtggggagctggagtctcccaagcccctggtgacccctggtagcacacttactctgctgaccagggctgaggctggaagccccacaggtggactcttcaacacgccaccacccacacccccagagcaggacaaagaggacttcagcagcttccagctgctggtggaggtggcgctacagagggctgctgagatggagcttcagaagcagcaggacccatcactcccattactgcacactcccatccctttagtctctgaaaatccccagtaggcatctgccaagaagggtgctgaaggctccagccagctgtcctgggtttccgttttggttccctttcatacagagggttttctatggatcactgccaaacattgggatcatctcctctgtccagaggtcttcaacaggaagatgccagctggcaccactgcactgtgatgggggccctctcctctgctgactctgccgtttctccaggcctccgctcagtgatgagaccaagagatcggagacaagcatggtgctgctgcttctgctgcttctccagaaaatccctgggacacctttgttccagcctggtttcctgggctgggctcaggaaagctgccaaattcagtcctatgttgggtccaagctgcccctgtgctgtttctgtcaagccaggtgtggacattccaagttcatatgcgtgaacaaaagaaaagaggaacccagtggatgtaacagaaccgactccagttgaatgtttagatttttgctaaactgttttctttttcccttttttgctgtggtttgcattcacggcagtagttagcccaggtgtggggaacgagagtgcactgcatgatagcgttctggtgagctgggaaggacccaccactgccactgaggattgttttggaagaaaggaatatttttatcttggggaccagctaagtctctgcagtagtgtgaaattccaaatggttgttttatcattggtttggtttaccaaaaaaaaggcagggaaaaaaaaaaaaaacaaccgtatgagcgcattggcttgtctgccgcaggcacagaagggtagaaagccacagcagggggcagtccagcagactctgactcaactttctaggcacctagcagagaaagataagatcaaaaggtgtttggtttttcttttaatttttattgtagtttttttgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctgaaggagagggagctttgctctctctaggtgggcaagtttcctgggctctctgtgttgcctccctctggcttcttcctcccgtgccctctccccgtgtgccccagggggatcagggatcctcaccctcctgaggcccagtggggaagaatgaacatggcttcatccaggttaactgatgctgccatttgcccagcctcttccatcccagccctgtcagtgagcccaggtctggtgcaactgctgcaggatgcctgtagtagggaactctggaagtgtattgggctgaggtgggattttccctccccacagtgcactgagcaatggagggtggtgagggagccatgctgctgaattctggttggcatttccccattatgtaaaatggggtgttgggtagggcagactctgcttgggtttggttgtaagataaacctggaggagaagcacagttgtcccattgaattatttgagcaaaaactactgtaaataacttttttgtcttttgtcaaataaaatttttttttgtttttttaagc

SEQ ID NO: 190717 - DNA, 906 bp, Homo sapiens
  Payload ID: 17672
  Gene Name: TGFB-induced factor homeobox 2-like, X-linked
  Uniprot ID: Q8IUE1
  ENST ID: ENST00000283891
  CDS Start-End: 109-834
aagaaaggatgtgacgtcactgagataaccagctcggctgttagcaactctgttagcaacgctgtttgtctttctcggaaacaacagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggcccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctgtcacatccccgtcttctccagaacttgtgtctccagaggagcacgccgacttcagcagcttcctgctgctagtcgatgcagcagtacaaagggctgccgagctggagctagagaagaagcaagagcctaatccatgattgatgatgttccaaaaacccaagtagtcagtcccttatgtactgtggtaaacctgtttatgttcaccccaa

SEQ ID NO: 190718 - DNA, 928 bp, Homo sapiens
  Payload ID: 17672
  Gene Name: TGFB-induced factor homeobox 2-like, X-linked
  Uniprot ID: Q8IUE1
  ENST ID: ENST00000561129
  CDS Start-End: 131-856
tcggaaacaacaggtgagaattccccttacagacctgcccatgctttctaaagtggctctcccaaacctacctttgtcctaactcagttgtctgtgattctcaatatagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggcccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctgtcacatccccgtcttctccagaacttgtgtctccagaggagcacgccgacttcagcagcttcctgctgctagtcgatgcagcagtacaaagggctgccgagctggagctagagaagaagcaagagcctaatccatgattgatgatgttccaaaaacccaagtagtcagtcccttatgtactgtggtaaacctgtttatgttcaccccaa

SEQ ID NO: 190719 - DNA, 859 bp, Homo sapiens
  Payload ID: 17672
  Gene Name: TGFB-induced factor homeobox 2-like, X-linked
  ENST ID: ENST00000622167
  CDS Start-End: 65-622
caactctgttagcaacgctgtttgtctttctcggaaacaacagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctgtcacatccccgtcttctccagaacttgtgtctccagaggagcacgccgacttcagcagcttcctgctgctagtcgatgcagcagtacaaagggctgccgagctggagctagagaagaagcaagagcctaatccatgattgatgatgttccaaaaacccaagtagtcagtcccttatgtactgtggtaaacctgtttatgttcacccc

SEQ ID NO: 190720 - DNA, 905 bp, Homo sapiens
  Payload ID: 17673
  Gene Name: TGFB-induced factor homeobox 2-like, Y-linked
  Uniprot ID: Q8IUE0
  ENST ID: ENST00000321217
  CDS Start-End: 109-666
aagaaaggatgtgacgtcactgagataaccagctcggctgttagcaactctgttagcaaagctgtttgtctttctcggaaacaacagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccaaagaaaaaggtcaagatttctatcacttccccgtcttctccagaacttgtgtctccagaggagtacgccgacttcagcagcttcctgctgctagtcgatgcagcagtacaaacggctgccgagctggagctagagaagaagcaagagcctaatccatgattgatgatgttccaaaaacccaagtagtcagtcccttgtgtactgtggtaaacctgtttatgttcaccccaa

SEQ ID NO: 190721 - DNA, 927 bp, Homo sapiens
  Payload ID: 17673
  Gene Name: TGFB-induced factor homeobox 2-like, Y-linked
  Uniprot ID: Q8IUE0
  ENST ID: ENST00000559055
  CDS Start-End: 131-688
tcggaaacaacaggtgagaattccccttacagacctgcccatgctttctaaagtggctctcccaaacctacctttgtcctaactcagttgtctgtgattctcaatatagtaacgataagcctctttgaatatggaggccgctgcagacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcggatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggccagtggtccagacaatgtacaaagcctgcccctgtggcccttgccaaagggccagatgtcaagagagaagcaaccagatccggagtcggcccctagccagaagctcaccggaatagcccagccaaagaaaaaggtcaagatttctatcacttccccgtcttctccagaacttgtgtctccagaggagtacgccgacttcagcagcttcctgctgctagtcgatgcagcagtacaaacggctgccgagctggagctagagaagaagcaagagcctaatccatgattgatgatgttccaaaaacccaagtagtcagtcccttgtgtactgtggtaaacctgtttatgttcaccccaa

SEQ ID NO: 190722 - DNA, 918 bp, Homo sapiens
  Payload ID: 17674
  Gene Name: TGIF2-C20orf24 readthrough
  ENST ID: ENST00000558530
  CDS Start-End: 118-585
ccccgcgccccgaagagtcggccagccccgaactgccggagtaggggtgggaaccaaactttttcctgccccgggacagacacgtttacccaaggtccagcctagcccctaggcaccatgtcggacagtgatctaggtgaggacgaaggcctcctctccctggcgggcaaaaggaagcgcagggggaacctgcccaaggagtcggtgaagatcctccgggactggctgtacttgcaccgctacaacgcctacccctcagagcaggagaagctgagcctttctggacagaccaacctgtcagtgctgcaagatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtctt

SEQ ID NO: 190723 - DNA, 2399 bp, Homo sapiens
  Payload ID: 17675
  Gene Name: THAP domain containing 10
  Uniprot ID: Q9P2Z0
  ENST ID: ENST00000249861
  CDS Start-End: 514-1287
accatggaaacgaccatttccggtctggacctctcccgaatcgatagagccacacagtcgttgcagcttctagttgtattcgtgagagcccagtgcgtcaccacttcctcgttctattttcccagcctcataaaaacagagcgggagtattgggaggaggataagctggggaagaggctggccacactggttgctataaccaccaccacttccggtccgttcctctttacggcccacctcagcgctgcccgcgcgaaatttgtatccctctgcttgtgtccactggctcctggggagcagcgcagggaggaggaggaggaagatatcaaagagccctcccattgggggccccagatcgccacttccggtgaccagaggtagggaaggaaacaatcccgacccggagtggacaggtgaggaggggaggacttgcctcgccgaggccgctgcgaggagcgtgcccaagggcgaaggtccagggaacccggctcccgcgcaccgaagacggccgccatgccggcccgttgtgtggccgcccactgcggcaacaccaccaagtctgggaagtcgctgttccgctttcccaaggaccgggccgtgcggctgctctgggaccgcttcgtgcggggttgccgcgccgactggtacggaggcaatgaccgctcggtcatctgctctgaccactttgccccagcctgttttgacgtctcttcggttatccagaagaacctgcgcttctcccagcgcctgaggctggtggcaggcgccgtgcccaccctgcaccgggtgcccgccccggcacctaagaggggagaggagggagaccaagcaggccgcctggacacgcgaggagagctccaggcagccaggcattctgaggctgccccaggtccagtctcctgtacacgcccccgagctgggaagcaggctgcagcttcacagattacgtgtgaaaatgaacttgtgcaaacccaaccccatgctgataatccatctaatactgtcacttcagtacctactcactgtgaagaaggcccagtgcataaaagtacacaaatttctttgaaaaggccccgtcaccgtagtgtgggtattcaagccaaagtgaaagcgtttggaaaaagactgtgtaatgcaactactcagacagaggaattgtggtctagaacttcctctctctttgacatttactccagtgattcagaaacagatacagactgggatatcaagagtgaacagagtgatttgtcttatatggctgtacaggtgaaagaagaaacatgttaaaaactcaacatcaaatgctctgatgtgctatagattttcaaatctttactcacataattatctctttgctattgtaaatctttcacttcaagataatttgacagttgagtatcagcataatttgtttagctctaaggcaaaagtttgcttgcttgccaacacaatgaagataatacctacccacaaacatccctattctctactttcacctttttttttcttttaatccttttggtagaaatcaggttacaaagcaaaaccacaatatcagcaacacttcctaatcaaaattaagcattgaatatttgtttaagcttagttcagaagcaacgctcctacaggacttgacatttgctagttagaatatccctactcttctaaataatttgaaagtatagagcagtaacacagtaacagtgagcacagccaagcctgacactactaaatgatttggtagtgaagccaggacatctacccttgactattttttatgttatttatttattagtttgtccatttgtaacatgtatagatctgtcctgtgagcatttctgatgaatctatggttcttacagaaatttttcaaaggaatcaatttagagatagagttttcatatacttacattaacttattaatgaaatctgtttgcatcagtgcttactgcgacacattaattagcttgattaatttagattagaatcattaacatcatgaaaaataaaagtactacatttctaacgtattcccattgcaggtgttaggtattttttctgtcaacacctctcttttgaattctacatttgagaaataagcatggaaatattagctgccccgtctgccattcaccaggaaaaatttctatggcaattttgtaccatgaagtaaactgttacaatagtttctgagaagcatactataactctgatcttccattgagaataacaaaaataaatatcaattttacacctcatatgtcttcttagttctgaatgattagaagaacttgcatgtatttttatcctagaaggtttaaataatacatcaaagttattttcttccaaatgtaattttatgtctgctttaaggaaaataaaataaaatattaatagga

SEQ ID NO: 190724 - DNA, 537 bp, Homo sapiens
  Payload ID: 17675
  Gene Name: THAP domain containing 10
  ENST ID: ENST00000560604
  CDS Start-End: 1-383
aggtagggaaggaaacaatcccgacccggagtggacagattacgtgtgaaaatgaacttgtgcaaacccaaccccatgctgataatccatctaatactgtcacttcagtacctactcactgtgaagaaggcccagtgcataaaagtacacaaatttctttgaaaaggccccgtcaccgtagtgtgggtattcaagccaaagtgaaagcgtttggaaaaagactgtgtaatgcaactactcagacagaggaattgtggtctagaacttcctctctctttgacatttactccagtgattcagaaacagatacagactgggatatcaagagtgaacagagtgatttgtcttatatggctgtacaggtgaaagaagaaacatgttaaaaactcaacatcaaatgctctgatgtgctatagattttcaaatctttactcacataattatctctttgctattgtaaatctttcacttcaagataatttgacagttgagtatcagcataatttgtttagctctaaggcaaaagtttgcttgctt

SEQ ID NO: 190725 - DNA, 2114 bp, Homo sapiens
  Payload ID: 17676
  Gene Name: THAP domain containing 11
  Uniprot ID: Q96EK4
  ENST ID: ENST00000303596
  CDS Start-End: 474-1418
atcaggattcgggtcctcgtgaggagcagtccaggcgacagcgttccaacctaatacgcctctctcgcccgccggggacaagacgggctggggaaagaatctgctcttcggaggctatcgcagtgccttggaaggcggcaggaatccgcacacacccgccccggaagtgagccgcttctggcgcggggcattgtggggggcgtagtctctttctcaggcggtccttcgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggttttta

SEQ ID NO: 190726 - DNA, 833 bp, Homo sapiens
  Payload ID: 17677
  Gene Name: THAP domain containing 4
  ENST ID: ENST00000402545
  CDS Start-End: 76-654
aaacatttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcaggtgagcccagccctgctcccagcacgctcctgtcttctgtttgcagcggtctgtggagtcagcctcttcctcttccgtgagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 190727 - DNA, 2367 bp, Homo sapiens
  Payload ID: 17677
  Gene Name: THAP domain containing 4
  Uniprot ID: Q8WY91
  ENST ID: ENST00000407315
  CDS Start-End: 433-2166
ggtggcgcttcctcctcttagaggacccaggagcagttgtcgaggcggcagaggcgagctctgtccccgtccgagcagccatcttgcggtacggacgtgctcggcgcgcccatgtcgcggtacggacttgccccgccggggcgactcccccgcccgtctgcccgcctgccgacggacgctgcgaggggcctgcggcgccccgctggtccgaagacgcccgaacccgcggctggcgaggacgcgggcgggggctggggcgggggcgggcccgctgcgggcgcctgcgcctccatcttgccgtacggcgcggacgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatatta

SEQ ID NO: 190728 - DNA, 785 bp, Homo sapiens
  Payload ID: 17677
  Gene Name: THAP domain containing 4
  Uniprot ID: Q8WY91
  ENST ID: ENST00000402136
  CDS Start-End: 87-584
gagccaggtgcaaacatttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatatta

SEQ ID NO: 190729 - DNA, 969 bp, Homo sapiens
  Payload ID: 17677
  Gene Name: THAP domain containing 4
  ENST ID: ENST00000612200
  CDS Start-End: 184-693
gtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttt

SEQ ID NO: 190730 - DNA, 1568 bp, Homo sapiens
  Payload ID: 17678
  Gene Name: THAP domain containing 5
  Uniprot ID: Q7Z6K1
  ENST ID: ENST00000313516
  CDS Start-End: 402-1463
gtgaggccttggacctgtggcctttgggcttgggtgtctcctgtccgctctgccagtgagtcctcagctctccgtacgtggcccgtcgcccgcggcaagacggagggaaggcgctagttcagtttagctagcaatgcccttcttgcgcgaggactgctggctggtggcgaggcccaggagcctgtttgggtgttaacagttaaaacagtaaagtttgcgcgggcttctgtggttttcagtcttttccccacttcacgtgatctcatttcattgaacaacattaaccaccatttaagatacgtgaaacctgcgaagtggaaaggtgcacgcaaagttaatttacaccccccgcgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaa

SEQ ID NO: 190731 - DNA, 3306 bp, Homo sapiens
  Payload ID: 17678
  Gene Name: THAP domain containing 5
  Uniprot ID: Q7Z6K1
  ENST ID: ENST00000415914
  CDS Start-End: 155-1342
ggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacattttctgtaagataatatatacgtaatactagaagttggctagaatttgatgatattaaccatgtattattttcagtatttattgaattctgtggtctttgaccttttggctatagttacatattacagttatattatctgtaatagaaaggaagataaacttttttttttttttttttttttttttttttgagatggagtctcactctgtaacccaggctggagtgcagtggcctgatcttggctcactgcagcctctgcctcccgggttcaagtgattcttctgcctcagcttcccgagtagctgggattataggcacacaccaccacatccagcttatttttgtatttttagtagaaacggggtttcaccatgttggccgggctggcctcgaactcctgaccccaggtgatccacctaccttggcctcccaaagtgctgggattacaggcgtgagccaccgcgcctggccaagatagaacttttataattttattccagttgaactaaactaaggaaccacccattagcccagttcttaggagaggtacttcaaacttgaaagaatatgtatttcggtaacttatatgtggctaaccatcaaatacatagtcatctaagctaaactttctgtatttatacagttaaacttataaaccaaaaattttaatgaggttaattttaaatatattttagaaattacagtttgtatctgtttcttagtaggtgtggcctttaaaatatgtgcttattcattgttaaattccagaataatagagtaatacttaatactgtacattcccacttacgtatattttattaaaatttataagcaagaaattatacataagtggtcatgatcttagggagacaaagaatttctcttagaaaagagaagtaatggtaatgtaaataaaaatactgtttatattcacatgattttaagaaaactgtaaaagcaaagattttgtagtaatgacacaaatgtaacaaatagatgttttcttaaaattggcagtcagtataattatgtttctgcctatgatgttgaggaagttgtatcagtctgattcttagttttttcatctgttaagtagaacgtactattacttaccttaaagagtggctttgagaattttgtaaggaacaaacatgtttttggttctggaatataggaggtgctcaataaaagttgactctgactggcaaataatattgttttgtaaatgcatgatgattatttttggccatatttgacttagtttcattaggctaatattaattggtactatatgaaagtgagtcaactaattataaaagattagaaatgtcttaggtgacgatgggggaaaaacttaaaatttttgcataaattatggggagatgatagagttattacagtgttattaagtattcctatgttgcattttgcaaatacttaatttaatacagatgaaaataatcttgagtcacaataaagtaatgatatgttaagtttcaa

SEQ ID NO: 190732 - DNA, 868 bp, Homo sapiens
  Payload ID: 17678
  Gene Name: THAP domain containing 5
  ENST ID: ENST00000438865
  CDS Start-End: 182-349
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatttcctctacatgacaaagaaagactggaaaagtggttaaagaatatgaagcgagattcatgggttcccaggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatc

SEQ ID NO: 190733 - DNA, 3549 bp, Homo sapiens
  Payload ID: 17679
  Gene Name: THAP domain containing 6
  Uniprot ID: Q8TBB0
  ENST ID: ENST00000311638
  CDS Start-End: 69-737
agacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattccaaaccttccctctaaatgggatttaacccacatctgcgagatcagcgttatgctaagaggaaatcactgaggccatatctttttacaatctgaaaaaaaagtagtaaaaaggtagttaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaa

SEQ ID NO: 190734 - DNA, 3423 bp, Homo sapiens
  Payload ID: 17679
  Gene Name: THAP domain containing 6
  Uniprot ID: Q8TBB0
  ENST ID: ENST00000380837
  CDS Start-End: 69-611
agacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatgaaataatttcatgttacgttccacctaaaattgtcattggtacaaatttttataaaatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagcttttgtcataattccttaccgaaaacaactgaaattgagagtcataaatactgtgggttagaataaaaaccatttgccaaagcaacactctacttagaagcacatgtacatacatggacctcattcagaagtccatgttgtagcagttagaatttgagtatcagccatttcattgtagtaacaaaaattgaattgcattttgtgctcagttgtttattgtaattttatttttgttacattaatattagttaagatatggtcacttgaattttttgtatttaagaattttctgttttaatgcatgttatacttttatgtaggattccaaaccttccctctaaatgggatttaacccacatctgcgagatcagcgttatgctaagaggaaatcactgaggccatatctttttacaatctgaaaaaaaagtagtaaaaaggtagttaaaaaaaaaaaaggccgggtggtggctcatacctgtaatcctagcactttgggaggccaaggcaggcagatcacttgaggtcaggggttcaaaaccagcctggccaagatggtgaaaccccatctctgctaaaaatacaaaaaaaaattagccgggcatggtggcacgtgcctgtaatcccagctacttgggagactgaggcaggagaattgcttgaacccgggaggcggagattgcagtgagccaagatcacgccgttgcactccagcctgagcaacagagcaagactccatctcaaaaaaacaaaactactttcattaattacccattatttattttagttacttaattttgagttcataaatggccaccctaatggaaagtttgggtatgatcttaggttttatggagatgttttcaatagagattatttttccctcaccctatttgtgaatatataaattaaagtaagacaatggagtaagtaagagggtagatccaaacacagtatgtctaaattctagcactctactggctgcttagaatacaccaaacctggaagacctttccaagagtaaaatcccagtctgccactatcaaaattgccacagtcacttttactacttgtgttcatagtagactcagcacttctttttcactggacctagtataactgagaaataaataactgtgtgcaaaatattggtatcattaaggacccagagctgcccattttctctttgttctaatagggaagcaattactgatagaaatgtgagattaaaaatagggtcctccctgctgctccaaacaaatgcctaaacacagtatgtatctcagtcctctgttcccagagattccaccctagcccaggaaagaactggcctgtgtaaagcaaaacccaagtcatccccctccagaaatttctctggcagccaagcctgaccctaagggttccactttgctttaaaagctaggagtggcctctagagccaggaacacattaatacaacagttcaacctcagcaccaagtcaggtacgaagcgcttgatacgtggaatttttctctatatcaagtttaaatttctggaaatagactttggttgctaatgacaattacagttataccatagtctgtaatttgagaaaaggtgaaatgtatttaatatatatttagttttaataaaaagataaaattattacagaaataattgagagagagaaaatctattataatttatttgaaaaataaaacattttatccagtaa

SEQ ID NO: 190735 - DNA, 313 bp, Homo sapiens
  Payload ID: 17679
  Gene Name: THAP domain containing 6
  ENST ID: ENST00000506261
  CDS Start-End: 74-313
cagagaccactgtgcaagcctaatcacttcccaagaagggttttgctttaaagttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactg

SEQ ID NO: 190736 - DNA, 1161 bp, Homo sapiens
  Payload ID: 17679
  Gene Name: THAP domain containing 6
  Uniprot ID: Q8TBB0
  ENST ID: ENST00000514480
  CDS Start-End: 493-1161
ggtaataactcttaggttgcctgttttcccccaatcgctacccgcccaaatctcagggcgtagttcggcgcgaggttggcggcagcggcgcggagacgctggttggccccagaggaaaggacgctcactgggcgcatcgttacctgtgacgggtcctccctctctccctccggtggcggggagcctggagaaaggggcggagctcggcccgggccctgggctcagcgggtcccgcgcgctgctcttggacgccagggtgctcgctggcacctcgaagtgcttcttgcttcctccctttcccgtttacttgctgttctttcaaaatatgtactgacattcactattgccagtcaccagctaaaccgtgaggacaaaaagtaaggaaaaatagacacactccaccatgacctcatggaactaacaagactggtggaggaggaagacattaataagagcaatcactgcaataaatttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgaacatagctacagtgtaatggacagtccaaagaaacttaagcataaattagatcatgtgatcggcgagctagaggatacaaaggaaagtctacggaatgttttagaccgagaaaaacgttttcagaaatcattgaggaagacaatcagggaattaaaggatgaatgtctgatcagccaagaaacagcaaatagactggacactttctgttgggactgttgtcaggagagcatagaacaggactatatttcatga

SEQ ID NO: 190737 - DNA, 896 bp, Homo sapiens
  Payload ID: 17679
  Gene Name: THAP domain containing 6
  ENST ID: ENST00000507885
  CDS Start-End: 92-451
agacgcagtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttaaacacaggaaaaggaaacaagaacaggaagaagaacaaaaaccaagaagagagaaatgcatttcatagggaatggcaagtggacaggcaacagtggtcagatatccatgttcaagaggaaatgtttgttcaaggcaaaaaattatttctcagtaaccatcatagctaacatttataagagacagagtctcactccatcacccaggctggagtgcagtggcgcaatctcggctcatcactccgtcgcccaggctggaatgcagtggcgcaatctcggctcactacaacctctgcctcccaagttcaagtgattctcatgcttcagcctcctgatcagctgggactacaggagtgcaccaccatgcccagctaatttttgtattttttggtagagacggagtttcaccatgttggccaggctggtctcaaacttctggcttcaagtgataccccccaacctcggcctcccaaagtgctagaattacaggtgtgagtccccaccaccacatctggc

SEQ ID NO: 190738 - DNA, 542 bp, Homo sapiens
  Payload ID: 17679
  Gene Name: THAP domain containing 6
  ENST ID: ENST00000507557
  CDS Start-End: 121-390
tcccggggctacgaggcggaagcgaaggcagacgcagtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacagatatccatgttcaagaggaaatgtttgttcaaggcaaaaaattatttctcagtaaccatcatagctaacatttataaggtgccaatctttattcaaagcacttaaactttattaactcatttaacttcacaacaaccctataagagacagagtctcactccatcacccaggctggagtgcagtggcgcaatctcggctcatcactccgtcgcccaggctggaatgcagtggcgcaatctcggctcactacaacctct

SEQ ID NO: 190739 - DNA, 543 bp, Homo sapiens
  Payload ID: 17679
  Gene Name: THAP domain containing 6
  ENST ID: ENST00000504218
  CDS Start-End: 446-543
atagtgctcgcagccccgctgacctcgctcttgaccgctggcgccatcttcccgggccgtcgccgccatctcctccacctcccctcacattccaccgatccttcccccaggataaaaaccacgcccagagaagctgcgcctctctagcacacccctcccagccccagcggccactagcgacaatatggctcctaagcacgtgacccggggcagacggatttccggttcccggggctacgaggcggaagcgaaggcagacgcagtctccgtcgttgacgttagtcgcagtcttcgctgctaacgtcaccagctaaaccgtgaggacaaaaagtaaggaaaaatagacacactccaccatgacctcatggaactaacaagactggtggaggaggaagacattaataagagcaatcactgcaataaatttttgttatgagttgctaaaatggtgaaatgctgctccgccattggatgtgcttctcgctgcttgccaaattcgaagttaaaaggactgacatttcacgtattccccacagatgaaaa

SEQ ID NO: 190740 - DNA, 1004 bp, Homo sapiens
  Payload ID: 17679
  Gene Name: THAP domain containing 6
  ENST ID: ENST00000504190
  CDS Start-End: 92-325
agacgcagtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacagaaacacaggaaaaggaaacaagaacaggaagaagaacaaaaaccaagaagagagaaatgcatttcatagggaatggcaagtggacaggcaacagtggtcagatatccatgttcaagaggaaatgtttgttcaaggcaaaaaattatttctcagtaaccatcatagctaacatttataaggtgccaatctttattcaaagcacttaaactttattaactcatttaacttcacaacaaccctataaggtaggtactattattattattctcattttacagaagaggaaattaaacagagaaaagctaggtaatttgcccaaggtttcacagctggtataacgatgtcttcatatcattatatgaagtcacgttgttgtttgttctgatctacaatgcaagagccagagacttttgttttgttttgttttgtctttttttatttattctggagacccagagactttgattcactcattgttgaattgttgctgaacattcacaatgtcttaaaggccagacttcagtcactccatttggaagctccagttggggcatttagaggctgaaggataaaatgtgaactcatcttgtgtctgaagctgaggaaagcccatagttactcattaccacaatctggatctgtctgatgctactgccaagcataaacagggcagatgcacactcaggatgaagtcaccttaccacatacacaggcaaaacattcaaatatccacaggtctcaccagcaa

SEQ ID NO: 190741 - DNA, 582 bp, Homo sapiens
  Payload ID: 17679
  Gene Name: THAP domain containing 6
  ENST ID: ENST00000502620
  CDS Start-End: 86-382
agtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacagatatccatgttcaagaggaaatgtttgttcaaggcaaaaaattatttctcagtaaccatcatagctaacatttataagggtcttactctgtcacccaggctgatgtgcagtggtaccatcagctcactgtagcctcgacctcccaggctcaagtgatccttccacctcagcctcccaagtagctggaactacaggtgacttagatacagacactgaacagacaaaccaatgaataattccgtcttggttgacaattggttgggacaagttcacatgccaagatgtcactgaaccacaagatcctacagtcactgacaactatttcctaacat

SEQ ID NO: 190742 - DNA, 1103 bp, Homo sapiens
  Payload ID: 17679
  Gene Name: THAP domain containing 6
  ENST ID: ENST00000508105
  CDS Start-End: 92-427
agacgcagtctccgtcgttgacgttagtcgcagtcttcgctgctaacgattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttgtaagtaaattacttgctgagctcatgttaattcttttaagatgaatatgtcctctccattacaatcaaatttttcagaatcctagcaaaatctaggggttaatatgtaatatctacaaataatattgcttcctagagtcattgtaatttatatatatgcaacagcaaaatagaggtagttaatcctttggttacatatgtagttcactgaagaaggcttttgcaaggatatttctaccaaggaaataattcttccctctaactgctataatttccgtatgaaatatgtaataaaaaatagctatttaagttttctcagtcatacacatacagagtattcaagcttgcatttatttattcatctcattgcttattcatgttagaggcaggcatggaatctagatctcttttactatcttgattaatacaggtttataataattttttctatttttgtgggtacatagtaggtatgtatatttataggatacatgagatttatttaggtatacaatgcatgataatcacattagggtaaatagggtatccatcacattaagcatttatcttttatgttacaaaaaatccaattatacttttagttatttttaaatatacaataaattattgttggctatcgtcaccccattgtactatcaaatactagatcttagtctgtctaactatatttctgtacccattaaccatccccacctccccc

SEQ ID NO: 190743 - DNA, 1134 bp, Homo sapiens
  Payload ID: 17679
  Gene Name: THAP domain containing 6
  Uniprot ID: Q8TBB0
  ENST ID: ENST00000507556
  CDS Start-End: 69-551
agacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgtattccccacagatgaaaacatcaaaaggaaatgggtattagcaatgaaaagacttgatgtgaatgcagccggcatttgggagcctaaaaaaggagatgtgttgtgttcgaggcactttaagaagacagattttgacagaagtgctccaaatattaaactgaaacctggagtcataccttctatctttgattctccatatcacctacaggggaaaagagaaaaacttcattgtagaaaaaacttcaccctcaaaaccgttccagccactaactacaatcaccatcttgttggtgcttcctcatgtattgaagaattccaatcccagttcatttttaaacacaggaaaaggaaacaagaacaggaagaagaacaaaaaccaagaagagagaaatgcatttcatagggaatggcaagtggacaggcaacagtggtcagatatccatgttcaagaggaaatgtttgttcaaggcaaaaaattatttctcagtaaccatcatagctaacatttataaggtgccaatctttattcaaagcacttaaactttattaactcatttaacttcacaacaaccctataaggtaggtactattattattattctcattttacagaagaggaaattaaacagagaaaagctaggtaatttgcccaaggtttcacagctggtataacgatgtcttcatatcattatatgaagtcacgttgttgtttgttctgatctacaatgcaagagccagagacttttgttttgttttgttttgtctttttttatttattctggagacccagagactttgattcactcattgttgaattgttgctgaacattcacaatgtcttaaaggccagacttcagtcactccatttggaagctccagttggggcatttagaggctgaaggataaaatgtgaactcatcttgtgtctgaagctgaggaaagcccatagttactcattaccacaatctggatctgtctgatgctac

SEQ ID NO: 190744 - DNA, 1213 bp, Homo sapiens
  Payload ID: 17680
  Gene Name: THAP domain containing 7
  Uniprot ID: Q9BT49
  ENST ID: ENST00000215742
  CDS Start-End: 176-1105
cgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggag

SEQ ID NO: 190745 - DNA, 1144 bp, Homo sapiens
  Payload ID: 17680
  Gene Name: THAP domain containing 7
  Uniprot ID: Q9BT49
  ENST ID: ENST00000399133
  CDS Start-End: 112-1041
cccgccccgccccggtggcgggggcacctccggctctccagtctctatggtaccaacttccggcgcgcgctacccctcgcgagacttcggcggcgcagcaatggccagagcatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctaga

SEQ ID NO: 190746 - DNA, 1825 bp, Homo sapiens
  Payload ID: 17681
  Gene Name: THAP domain containing 8
  Uniprot ID: Q8NA92
  ENST ID: ENST00000292894
  CDS Start-End: 546-1370
cacagccagtgtactggatgcctgattaagcgtcatggggtctttcatccagactgcgttttcattattcgctgaaacatacaggttttaatttttacgaggctaaggccacggccgcctcacctcggtttttgccgccacctagaggaactatgtgcgccccaacggttgcccggatgtaggcgtagggtggagccgtaagagattgactagccagttgatttggttggcgcaggctcagaaacgccgtgacgccgcccttccccccaacacgtgatgaaagtcggggtgacgaagggccggctttgcgcaggtgcacagtactcgctatggcccattcgtcacgtgacgagggcgggactgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcagacatg

SEQ ID NO: 190747 - DNA, 1084 bp, Homo sapiens
  Payload ID: 17681
  Gene Name: THAP domain containing 8
  ENST ID: ENST00000522483
  CDS Start-End: 161-358
gtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaaagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggaga

SEQ ID NO: 190748 - DNA, 842 bp, Homo sapiens
  Payload ID: 17681
  Gene Name: THAP domain containing 8
  ENST ID: ENST00000607730
  CDS Start-End: 185-310
tgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctg

SEQ ID NO: 190749 - DNA, 3808 bp, Homo sapiens
  Payload ID: 17682
  Gene Name: THAP domain containing 9
  Uniprot ID: Q9H5L6
  ENST ID: ENST00000302236
  CDS Start-End: 52-2763
gattcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatgcctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattaatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttatgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagta

SEQ ID NO: 190750 - DNA, 553 bp, Homo sapiens
  Payload ID: 17682
  Gene Name: THAP domain containing 9
  ENST ID: ENST00000514440
  CDS Start-End: 120-212
aaagcccgcctttcgtgacaaataaaggtcgtagccgcagagtcaacgggcggagctaaagtggtcgtgattcatgctgtcgcgggaaccccgaaggtggggccccacgtaacaagaagatgacccgaagttgctccgcagtgggctgcagcacccgtgacaccgtgctcagccgggagcgcggcctctccttccaccatgtttacctctgaatagccggttctcgcaccgcctaccgctttaaggagagttacgcgaaaggagtcctccattaattggatggtcttattatttgaaagacagggtttcaccatgttgtccaggctggtcttgaactcctgacctcaagtgatccgcccgcctcggcctcccaaagtgttgggattacaggcgtgagccaccacgcctggccgacaagtttctaaacataatttggcttggattgaaaaataaataaatgcaagatttccaactgataccatacagcgctcaaaatggatcagggctgttaatcgtgtggaccccagaagcaaaaagatttggattccaggac

SEQ ID NO: 190751 - DNA, 565 bp, Homo sapiens
  Payload ID: 17682
  Gene Name: THAP domain containing 9
  ENST ID: ENST00000506208
  CDS Start-End: 1-366
agtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgagcggccagtgaggcaggaggaaaaccaggagattgtgatggcctggaagccaagtgtagaaagtatttcaaggagggagtagtccactatgtcaaatgctgctgggagatcaggtggttatccaaatgccaacccagtccaggtttcaacagcaacattttttcttttcttcaacgaagagtagagaatggagatcagctctatcaatac

SEQ ID NO: 190752 - DNA, 821 bp, Homo sapiens
  Payload ID: 17682
  Gene Name: THAP domain containing 9
  ENST ID: ENST00000514244
  CDS Start-End: 101-409
aaataaaggtcgtagccgcagagtcaacgggcggagctaaagtggtcgtgattcatgctgtcgcgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaaggtatttaaatattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcct

SEQ ID NO: 190753 - DNA, 3348 bp, Homo sapiens
  Payload ID: 17682
  Gene Name: THAP domain containing 9
  ENST ID: ENST00000505901
  CDS Start-End: 35-343
gaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagatgaggacacaagggattgtagagcttatgtgacagctaattgagggagctaagattcaaacccagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatgcctctcaagcaacagcttcagtgggatcctagcagtcacagtttgcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattaatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttatgattcttaagaatattgacaatacctataaaactttgaagataacttttacttaaatatgaaaattatagtttgaaaattaggctcaagcaaatatcaaatactgcaaaaatccccttgtcccaggataccc

SEQ ID NO: 190754 - DNA, 700 bp, Homo sapiens
  Payload ID: 17682
  Gene Name: THAP domain containing 9
  ENST ID: ENST00000509353
  CDS Start-End: 38-367
cgggaaccccgaaggtggggccccacgtaacaagaagatgacccgaagttgctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaaggtatttaaatatgaggacacaagggattgtagagcttatgtgacagctaattgagggagctaagattcaaacccagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcagattttaa

SEQ ID NO: 190755 - DNA, 2161 bp, Homo sapiens
  Payload ID: 17683
  Gene Name: THAP domain containing, apoptosis associated protein 1
  Uniprot ID: Q9NVV9
  ENST ID: ENST00000254250
  CDS Start-End: 232-873
gaagctgcctccgccatcttggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaagaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaagtgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggca

SEQ ID NO: 190756 - DNA, 1943 bp, Homo sapiens
  Payload ID: 17683
  Gene Name: THAP domain containing, apoptosis associated protein 1
  Uniprot ID: Q9NVV9
  ENST ID: ENST00000345117
  CDS Start-End: 212-373
ggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaaaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaagtgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatgg

SEQ ID NO: 190757 - DNA, 461 bp, Homo sapiens
  Payload ID: 17683
  Gene Name: THAP domain containing, apoptosis associated protein 1
  ENST ID: ENST00000529779
  CDS Start-End: 108-461
ccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaagacccctgttaatctctcagttttctgtgaccacaactatactgtggaggatacaatgcaccagcggaaaaggattcatcagctagaa

SEQ ID NO: 190758 - DNA, 5719 bp, Homo sapiens
  Payload ID: 17684
  Gene Name: THAP domain containing, apoptosis associated protein 2
  Uniprot ID: Q9H0W7
  ENST ID: ENST00000308086
  CDS Start-End: 1502-2188
atacagctcttccgaggtggagagggctctcgccagctctgactgctgctgaacccggatcctgctcctcctcccagaggaggtctgcaccccggcttgcctcctcgctcacccactcctcgcccccgactccagcgactcccaccccggtaaggcctgcctcgaaagcggaaacggtccaaggcgaggtggctccgctcccagaaagacggccggggactgctttcggacagtgagctcgaaggcatccgtacagaaggcggatgagaccggaacggttctttgggtcggtagctgctgggtcccctgaggtggccccgctcagacgcgtgccgcgagcgtgagaaattcctcagctgctgctgagaagaggacgatgacgaggaagagccaccgcctccgccagatccaccgccccgggccgagtgaggaggccttcgccgcggatagggtaacagcccgccgccgctgctgctgctgctgctccgactccgtatctggctgttattatcgtcgtcactgatttccccatcttcaagctccccttcttccttcggcgagaggccactggaggccggggccggagtatctgcggtcgccatccggggagcagcgccttccacacaaccttagccctccgtccggggatccgcccgacaattgcctcgtttcccttctttcctaacggactgggtcggtgcggtcttaccctactcggacaccaagcggcctctgctccccaacttccccgcaccccagcaccccagctctctctcgccggaccgtcgcaacccagttccctttcctagcgcccccttgctcctcagcgatcggggttcttccgcctcgcgagaaagggactctggtagcggctgtacccgaaacgtcacttcctgcgacacgcaggaaacaaaggctcccagttcacgcgataataagaccaactcgatactcactaggatttgtagtctttcgtctttcttcgggtttactcttccggtcctagggtcacacccaccgcagggtctggcttggtacagttgggtgcatgcagaagtaggtggagctgctgttgcagccttgagagagttttattgtaaaactcttgtaatttatagtaatcggaggggaaaacacctcttccttttaattgctctgaggaccgctgccaaagaaacgcagtagatccgctccctcttgggggcggggagaaagaacgggttgtgtccgccatgttggtgaagtcaagcgaaggcgactagagctccaggagggccagttctgtgggctctagtcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccactacctacaacaagcacattaacatcagcttccacaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaaagaatttagaagcaaatagtgtattacctaaaggtacatcagaacacatgttaccaactgccttaagcagtcttcctttggaagattttaagatccttgaacaagatcaacaagataaaacactgctaagtctaaatctaaaacagaccaagagtaccttcatttaaatttagcttgcacagagcttgatgcctatccttcattcttttcagaagtaaagataattatggcacttatgccaaaattcattatttaataaagttttacttgaagtaacattactgaatttgtgaagacttgattacaaaagaataaaaaacttcatatggaaattttatttgaaaatgagtggaagtgccttacattagaattacggacttaaaaattttgctaataaattgtgtgtttgaaaggtgttttttgtttttgtctttttaaactactgttaaaagaacagcttatgataagtaatatgtttaacttagagaagaattttttcctgtaccaaagttggcatattgcattctaaataagatgctaaataagagttaaccaacattcaacatgaccttaaaactgctgggttttgtattaattaaattataattggcactgtgatttgaaaaatttatagaaaaaaaggtacagggcaagtttttaaattaaaactttctatattttgttttaccagtaaaagtgagcttatcatggcctctctcataagaatgattttaaaataggttgtaaaatattttgaaaatatttgaatgtgaagtaccattgagtcatccaaactaggtaaggcctcaagtactttaaactagtaaaatctagtagctgataatattcacctaagtaagtgttgtaaaataattcagagttcaggacctagcttagataaatgtatactactctttttctcataataaaaatcttacatttccaacttcaaaattggtgcttccatatttgttgataaccaaaactcctaaggttttttgttttctttttaactactttccaaatgcatactatacctcagaaatagtgtatcaatatagtgggctttttttttcctcttcataaacccacagtaaaatttaatcacaggaaactacttatatcttcacactttgtattgataacttaaaatggcatcagtttatcttagacatcagcttgctttttatctccttttttagtgagtgaaatagagcaactagcatgcctgtgttcccagctacttgggaggctaaggtgggaagatcaattgaacctaggaggttgaggctatagtgagctgtgattgcacgactgcactccagcctgggcaatggagtgagactcctgtctctaaaacagcaacaacaaaaataaagcaaccatagtgcataagggaaattaaatgttccctatagaaatatgtgtatgtctgtgatagtggtatgcaaatgctaattattttataaaataaaagttcagaactattcttatcattgccacttgaacaattaaagggtttgctttatttcactaatgtttaataggaaccctttgcttcaaacagctttgttgaaatcatgtaaaaatttgttaatagagaatcaagttatttaactcaacttatttaattcaagcttgtgatactaacatacaaaggtagcataaaccaagtcataaattgctgtaatctttcctgtaaagtaatagctacttcatgatttttttaaaaatttcatttttttgctatttaggattgcatttgcttggctcctagtaacaattcttttacagtattagcactctctttactaaggaatgcctcccaaggaaatgcaaaggtaggaaaagtctcttagaatgcccatgaggtatttaaaacagatatttatgaaaatctttttgtgaatgttataaatcttgctagttattttatctttatcttaagtattagatgtagttccttggaattgtcattacatatttatttttttctagtatggtttcaaataactttttgccaacatataatcatcatcaaacattcactgaccatatctattttataactcaaaataagttggacaaataatcattttaataaaaactattttttccaagtataaccactgtcatgtggttcacccttcaccccagatacaaaacacttatttgtgtagcccagttcccatctacagtaataccttgaaaccttaataaattttaaaaatcataaaaataaaatattgtaaaatacaacaaattttggacaaggttacttcatcttcattcattattacctgacagtattaaactactactcaataattttagagtaaacttttctgtgttttctccgtgattttcattgtgctgtcctgacaacatgctccaaactctttgcatcaaattgttttattaacatacatttgtctaccttaaaactagctttattcacagagaaaaacctaaaaggagtctattaaaatgctgctttcagtttgatagttttttttttaatcactctgaccataaactaactgaaattataatggattttttttcctctcccggtcacaacacagatcttctgttcatttgttctctgtctactgggcaccaacctctacaaagaaccagccaaaggctaggtacttgatataaaaaggaatattacattattttctgccctcaagttgctctatctcctgaaagaaacaagtaatatttataatacaatatgataaatgctacaaaagaaatagctgtaaagtcctttggtaaatgctgttgaattggaattcagtaagaactataaactgtagacctttttataatcaaatgcttttgtcttgaaacaaaacagattcctccttatattgacttagcaaaggaggtacaaggacattggcatttgacctgaattatggtgttttattgaatgagctataagacaacatttttaccctttaaaatgaacactgaacaaatgtgttaatggtatctttgttaaaaggaaaacatagctataaataaaatactacatcgaaatccagcactggagttcatttgaaatttgatattttgtgtaaaataacaaacctattaacacagatttttaaaataactcagaatcgtataaagcactttggtacttatttgttctcttttcccttacattctgtgtggtaggtggtattatctctgatttacacatgaagacatccttgttaatgcaatttatttattcattcgggcatttactgtgtgccaacttgcaaaaggaatagaaatgtctgtgatctagatagttctagattgaacatagattttctgccaacaaatcctctctgctgttcacattatcctttgtttaacgtatgaaccaggttactaaaataggataaatcatgtgtcttaaaatatgaaaatagtaaagtctttgaggtcacttgatcttctctaagtagactttataatattgtgttttatctcatttctcaatattagaatacgggtagattttaattttgctataatataggaaatggttcatctttgtaccaaaatattgcattcttctgatatttagacagttggaaactttctaaaattgaggattttgtagtgtatactaaataattgcatattcaaaaaaatgtattctgagtatggtgatattaaacatttttccccaa

SEQ ID NO: 190759 - DNA, 577 bp, Homo sapiens
  Payload ID: 17684
  Gene Name: THAP domain containing, apoptosis associated protein 2
  ENST ID: ENST00000551238
  CDS Start-End: 274-577
tactaccaagtctagtttcaagctatcaatatgacatcactgattatggagttggaaagagatgtgcagtttcacactattttagtatttccaccatacagatacaacagacaaccttaagagtaaaggtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaa

SEQ ID NO: 190760 - DNA, 584 bp, Homo sapiens
  Payload ID: 17684
  Gene Name: THAP domain containing, apoptosis associated protein 2
  ENST ID: ENST00000551488
  CDS Start-End: 254-584
attcagagacctaacttagtcttggaaagtcaaagaacactttttcaaaggatgtgacatttcaaatgagaccaaaggatgacagattgggtcctgtgtgctacttaagtttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatgaaactcaagtcaaggaatcttttgaagaaaaacaacagttgttctccagctggaccatctaatttaaaatcaaacattagtagtcagcaagtactacttgaacacagctatgcctttaggaatcctatggaggcaaaaaagaggatcattaaactggaaaaagaaatagcaagcttaagaagaaaaatgaaaacttgcctacaaaaggaacgcagagcaactcgaagatggatcaaagccacgtgtttggtaaagaatttagaagcaaatagtgtattac

SEQ ID NO: 190761 - DNA, 672 bp, Homo sapiens
  Payload ID: 17684
  Gene Name: THAP domain containing, apoptosis associated protein 2
  ENST ID: ENST00000547843
  CDS Start-End: 30-188
taagggcgctgaatgagtgggaaagggaaatgccgaccaattgcgctgcggcgggctgtgccactacctacaacaagcacattaacatcagcttccacagaccgggccttgacatgaatgacgccgtaagggagaaagagatcttcccaatcagcaatcaccgtaaaagcctgctgtgttcccgttaaaattaggaaattctcactagatgaattgacatgggaggcatttagatttctaatagtcacatagtaattctgcggaggaattgagtcatctttgatagccatggaattaagcgatgttaattaaagtgcaaaagataacctttctgttcttactagaatagagtaataaaaagaacctaggttttcttttgtttgctggaagaaaaatcaaaattctttagttctgtcaaaccagaactcttgaaagcactttgaacaatgcctggaaaataacaggtactctgtaaatgtttaccttctctgcaagtgcctgccacgtgcccgaagaaaagacacattaaaaagttaagtgacaccagtcctgattttatatattttatatacctaacaacgtatatgttagtatgtagaaattatatccttgacctttttccctacctattacgaactgtacttttattaaaagctgccacttaaaaaaaat

SEQ ID NO: 190762 - DNA, 1366 bp, Homo sapiens
  Payload ID: 17685
  Gene Name: THAP domain containing, apoptosis associated protein 3
  Uniprot ID: Q8WTV1
  ENST ID: ENST00000054650
  CDS Start-End: 159-878
ttccagttgtccaagcctgtgagtggctatgcgtcctggttgggtgctcaaagcaaggaggtgaaaggcgaccagcattggcgaatggggtccctcccctctccgcaggccccgccgccgccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagcacacgcagagcaaagatcgttggaagccccagtgtgggagatgctcctcagggaggaagccatgtgagggggctggctctgtggcgggtgagtggtcccctcctccatcagcctggacagccgctcggggttctaaggagtgactcctgtcccggcctggtgtgagtgggcagtgtaataaagtgtctttctatacgg

SEQ ID NO: 190763 - DNA, 1046 bp, Homo sapiens
  Payload ID: 17685
  Gene Name: THAP domain containing, apoptosis associated protein 3
  Uniprot ID: Q8WTV1
  ENST ID: ENST00000307896
  CDS Start-End: 39-755
ccgccatctttgttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggccggcagagctttggagctctggctgtggacatttttgtctgctgtggacactgagaaagttggccatgaggcctgcttggccggggatcgagacagtagccaagctccccggcgagagccccaatgccgtctgggggacgtttagaggcgtggcactaggagtgcacatctgtgagcatgacaagcttatcctcccatggtaacagaagtccaggctgaggctgattctggacgctgtcctttcagca

SEQ ID NO: 190764 - DNA, 2053 bp, Homo sapiens
  Payload ID: 17685
  Gene Name: THAP domain containing, apoptosis associated protein 3
  Uniprot ID: Q8WTV1
  ENST ID: ENST00000377627
  CDS Start-End: 28-555
gttgggggcagccaggcctggctcgagatgccgaagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaagacttcaccctgccgttcccaggtcctccctgaggcgggggccggagaggacagtcctgggagaaacatggacactgcacttgaagagcttcagttgcccccaaatgccgaaggccacgtaaaacaggcaatgttgtttaatgtagaaaatggaaccccagcttcacgtgaagccttgtggttgagtgaggagtgaaggatggggaggaggcctctggggaaggggttccctccctcctgaagatgaacacacaatacacggaagagcgccagcctctgctttcaggaaaggtttattgtggtgagtgccttctgtacagtcgactgcaaatgaaacgcagaggatgggtgcccagaagcacctgcggcagaggcgcacgggaagcccggggcccaggctcatgcaacacgacgctcaccgcggctcgggccgtggggccgtcagagaaacctttttaaaaaatggagatgaatgttacagaattggacaacccgaactgcttttcaaaaccagaggaaggaggttcttagccgttactcagataccagtgctggggagggaggcctgacttcagcaacagctgtgggtgggctggaggccggcgcagcttggggccccccgcgccagctgtctcagccaccacctgtgcggcgcttgctccgaggggtcagcaagagcaactgatggctgccacttccaggccccgagagacaggcctcacgtaactttactgcagccgaggtccaggccgtggagggggtcctagctccgctgcattctgcatcccaagtgggcacgtggaggaagggtctgaaggaaggctccggagcacaggccctggtgttcctgtgaggacgctggacctgcaggagcggggagctgcagtgccacctgctgggtaccacgggccgggcctggggtccacgcctttgggttgggtgtgtctgatgtcttgccaagcgcctggtcctgtcctcttgagctgcccttgcccagcactgcactctggaggtgggtggtgcaggcggtggagggacacaggccagctcaagcccgctggtggcagggcgttttcccaccgggatacgggaagccacctgtgtcagggctaggccctgggatcgggagttacactaccctgtcccaagccgagggggccggtggaatgacttgagcagctctgggagtggggaaaaaagacgactaatttccaaacccgtttgttctcagataaaaagcagttttataaacccgcaatctgctccagattcaagcagtaatatttcagcaagaggaggtggtcatgggaagccagcacagcagaggctccctgaccgggaggcctgcctgcttttcaggttgtttcccatgttcagcgtggactgcagaagtggctcacgctcctgtggtgagggcagggtgctccacagacacctccagacccagccaagaactacagggcggcgggctgcggtcagcacgtgtgctcgggacacagcggagtcagggccagagcccttccctccaggaactgatccttgggaaaacagccatgggccaggctgcagtctggttcccagtggggctgcctcagtcctacccccagcaccctcaaaagctggggtgtctgcatgtcccttcacataattgataatggtaccaccttctataataataatataaaataaaaaca

SEQ ID NO: 190765 - DNA, 840 bp, Homo sapiens
  Payload ID: 17685
  Gene Name: THAP domain containing, apoptosis associated protein 3
  ENST ID: ENST00000487819
  CDS Start-End: 1-375
aagtcgtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagaatctccatgagggcaggggctgccttccctgcttcaggccccacacccaggacgctgcctggcacagcccaggtgctcgggcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggccagacttgggccagagcagcagagctgagccccacaggctccggacgcagaggtggcagtggcaccagggcc

SEQ ID NO: 190766 - DNA, 983 bp, Homo sapiens
  Payload ID: 17685
  Gene Name: THAP domain containing, apoptosis associated protein 3
  ENST ID: ENST00000472925
  CDS Start-End: 1-694
gtgcgcggcccggcagtgctgcaaccgctacagcagccgcaggaagcagctcaccttccaccggtttccgttcagccgcccggagctgctgaaggaatgggtgctgaacatcggccggggcaacttcaagcccaagcagcacacggtcatctgctccgagcacttccggccagagtgcttcagcgcctttggaaaccgcaagaacctaaagcacaatgccgtgcccacggtgttcgcctttcaggaccccacacagcaggtgagggagaacacagaccctgccagtgagagaggaaatgccagctcttctcagaaagaaaaggtcctccctgaggcgggggccggagaggacagtcctgggagaaacatggacactgcacttgaagagcttcagttgcccccaaatgccgaaggccacgtaaaacaggtaagactgagtgcaaaggtggtctgtggttggacacaagatgacttgctccaaacaaaatggaaaccagtgagcacccaccatgagacctgtgtggccgaggcagggtgtgcagcctgggtttcagagctccccagtcaaattctccaccatggtgtgggcacatctggattttgggggagcagcccggagtgtctagctgccctggggttgtgctgtgtgcgtgtctggtggcctgctcaccatggcccgccttcctgctggtgatgcagctctaggctctcactcccctgtcctcaggtctcgccacggaggccgcaagcaacagaggctgttggccggccgactggccctgcaggcctgagaaggacccccaacaagcagccatctgatcacagctatgcccttttggacttagattccctgaagaaaaaactcttcctcactctgaaggaaaatgaaaagctccggaagcgcttgcaggcccagaggctggtgatgcgaaggatgtccagccgcctccgtgcttgcaaagggcaccagggactccaggcca

SEQ ID NO: 190767 - DNA, 1211 bp, Homo sapiens
  Payload ID: 17686
  Gene Name: theg spermatid protein
  Uniprot ID: Q9P2T0
  ENST ID: ENST00000346878
  CDS Start-End: 1-1068
atgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaa

SEQ ID NO: 190768 - DNA, 1877 bp, Homo sapiens
  Payload ID: 17686
  Gene Name: theg spermatid protein
  Uniprot ID: Q9P2T0
  ENST ID: ENST00000342640
  CDS Start-End: 701-1840
tcagctcctttggcgacgtacgaggaattcctgaaggcagcagcctggggaatactccagttataaccattattttgttgtgagggttggaacagcctattttgaagttatttctcatgagaggttggggctggaagcgtctgtatcacctagggtgcagttttagctgctaggaattggaaaccaagccaaaacgacttagtactaaggaaacttactgtttcaagtaacaagaagcctggacacagagtggattccaaggctgctaagttcagaggctcgacagccacatcaaaggcccacctttcagttcatctgccctcagatggcaggcctcatggtcacaagaaggctgcctgggctctggacattaccgacgggccccacagggacaggaacaggagacgcggtctcttccttgtgtctccttttgagagagggaatccatagctagatgcccctgcaggttcccgtcaggtctccttcctaaaccaatcctgggaggtcctgagtgagccgtgaccaccaggactgagtcctgatcccagcgcaagcccaggtgaccagcattggagacggcgcacgggttagaatgtggaccgtggggaatgtgacggacgctctcctgttgccgcggccaccacagacacatttgggtgccgggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggaagggacgctgtggtaaggggtatgcctggatctccccatgtaagatgagcttgcacttctgtctctgctggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaa

SEQ ID NO: 190769 - DNA, 1162 bp, Homo sapiens
  Payload ID: 17686
  Gene Name: theg spermatid protein
  ENST ID: ENST00000530711
  CDS Start-End: 237-650
gcgagcagtggagctgcggttggtccaggccttcgtggtgccaaagtcctccctcagagacccctcgagggaaaggagaggcgggtgggcagggtgagtgcagacaaaaggcgcttgagcaagacccacgcttctctgggctcccaaacgcatcggggcgggaaagcagctccaacttcaacgtggaattctcccaaagccggctgtccatcagccagaagctccccagcaccaccatgaccaaagcaaggaagaggaggaggcggaggaggctcatggagctggcagagcccaagataaactggcaagtcctgaaagacaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaacctgcgacttgtccagctgtttattttccgagtcactttcattgaccatctcgagcgccttctgaatctcttcagtccagacttattcgtccattcctgagggcccacgggaccgtcggagtcggaacgacagccacagtcaaaccagccgacgctcctgctgaggggccacgggaccgtcggagtcggaacgacagccacagtcaaaccagccgacgctcctgctgaggggccacgggaccgtcggagtcggaacgacagccacagtcaaagcagccgacgctcctgctgagggcccacgggaccgtcg

SEQ ID NO: 190770 - DNA, 1650 bp, Homo sapiens
  Payload ID: 17687
  Gene Name: theg spermatid protein-like
  Uniprot ID: P0DJG4
  ENST ID: ENST00000512175
  CDS Start-End: 69-1466
gagcaaactgcgcctgggcaaccagtcgggagggtgagtcccgcgcgcgacagaagcttctggcgcgaatggagaaccaagagtttctaagttcatctgcgccgtccgaggtgaccgatgggcaggtctcaacagaaatatccacttgctccgaagtcttccagaagcccattgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtctttcctgggtgcaaatcctgtttcctgtgactttgtaaggaaatgtttttcttctaggaagagaaccccaaatctttcaaagcctaaaaagcaatggggaactccagacagaaaactgttttggggaaatcaagatcctattcgccctgtttcccagggtgctttgaaggctcagctgaccaaaagacttgagaaccttgcccagcccaaggaagtttcctgccactatgtacctaacagggctcaatactaccacagctgtggaagagagtctgtaatttgggagatcactcctcctgcattgtttagacaaccctccaaaaggatccagaggctgtcacagcccaatggattcaaaagacagtgtctactaaatagacccttcagtgataactcagcaagagattctcttcgaatctctgatccttctccccggatattacaactctcagtagccaaaggcacagacccaaactatcatccttcaaaaaaaatgcaaaccaagatttcactttctaccctgagtgcgattgcaactccaagaattatagagcttgcccacccaaggatcaagttagagggtctgtgctatgaaagacaaagaagtgaactgcccatccgtcctgtacctcctgctgccatgatagctaaacctagcccccgaacaatagctctagcgaagtccaagtctgttcatcaagattatctacctgaccgtgatgcccattggccagtatcttatgctactactcattccaaagcatcacctaggattcaggaactagctaatccaaataagagggctcctgtgcgtattgtgtattatgatccagatgtctttaaaaccaagccagctgctttgaaagcacagtgttctcaaaggatctgggagttgtcacaacctcttacacgttaaatacagaaagccacaacagtcagaccctggttatgtatctagaacacatattagatgacttagttccctgttgcggtactgtcagtttacattcaccccttgcttcccctcccacaaaatgagacctttagggaaaaccaccatgatcattaaatagcagttgttgctgttaacctgtcgctga

SEQ ID NO: 190771 - DNA, 2439 bp, Homo sapiens
  Payload ID: 17688
  Gene Name: thiamin pyrophosphokinase 1
  Uniprot ID: Q9H3S4
  ENST ID: ENST00000360057
  CDS Start-End: 104-835
aaggctcctcagccgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaa

SEQ ID NO: 190772 - DNA, 1920 bp, Homo sapiens
  Payload ID: 17688
  Gene Name: thiamin pyrophosphokinase 1
  ENST ID: ENST00000378098
  CDS Start-End: 104-469
aaggctcctcagccgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagaagaaacagtgaaaggaatactgttcaattccaacatcagctgtgtaaccgaggcatcgtaatacttttatgacaagtttcactacctttttgcctgtgccagtgtacctcaaagggatatggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgt

SEQ ID NO: 190773 - DNA, 2283 bp, Homo sapiens
  Payload ID: 17688
  Gene Name: thiamin pyrophosphokinase 1
  ENST ID: ENST00000378099
  CDS Start-End: 104-688
aaggctcctcagccgagcgccgagcggtcgatcgccgtagctcccgcagcctgcgatctccagtctgtggctcctaccagccattgtaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatc

SEQ ID NO: 190774 - DNA, 2243 bp, Homo sapiens
  Payload ID: 17688
  Gene Name: thiamin pyrophosphokinase 1
  ENST ID: ENST00000538212
  CDS Start-End: 72-641
aaagtactgtgcattttatgtactgcttgactacaacatcgtttgctttgctcttttaagagcctgtgccgatggaggtgccaaccgcttatatgatatcaccgaaggagagagagaaagcctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaag

SEQ ID NO: 190775 - DNA, 581 bp, Homo sapiens
  Payload ID: 17688
  Gene Name: thiamin pyrophosphokinase 1
  ENST ID: ENST00000552881
  CDS Start-End: 82-581
aaagcttttaacccgacggctcagggaggacaccggtagcaggactagaagcagcacagtggaaaaggccaataatccgttatggagcatgcctttaccccgttggagcccctgctttccactgggaatttgaagtactgccttgtaattcttaatcagcctttggacaactattttcgtcatctttggaacaaagctcttttaagagcctgtgccgatggaggtgccaaccgcttatatgatatcaccgaaggagagagagaaagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaacc

SEQ ID NO: 190776 - DNA, 2815 bp, Homo sapiens
  Payload ID: 17688
  Gene Name: thiamin pyrophosphokinase 1
  ENST ID: ENST00000482940
  CDS Start-End: 209-448
ggcagttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcaggatttacaatctctcttttaagagcctgtgccgatggaggtgccaaccgcttatatgatatcaccgaaggagagagagaaagattcctctgacagtatcctccaagacctgacatggacaatgtgtgaaaaagcgctcaacctccaacttgaaactctcctcgaggcccccagccaccagtcatctcatcaggacaccgaaagacacccattactgtggagcttccaagggtcttggcaactcttttatcggaaacgagagctttttgcctgaattcatcaatggagactttgattctattaggcctgaagtcagagaatactatgctactaagggatgtgagctcatttcaactcctgatcaagaccacactgactttactaagtgccttaaaatgctccaaaagaagatagaagaaaaagacttaaagaagaaacagtgaaaggaatactgttcaattccaacatcagctgtgtaaccgaggcatcgtaatacttttatgacaagtttcactacctttttgcctgtgccagtgtacctcaaagggatatggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcagaacttgtgactacactaggaccacctggatagccaaggataatcccgtcccaagactaatcagattaatcagacttaatcacatctgtaaagttcctcttgccatcaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaatccctatgttgctataagaaaagtgaaagtaactgttttcttcttggtgctatgacagtgtgagactcaggttgtctgtagagaatgaaaggagcagtggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttaccagtgttaataaatggatacttatcaaaaaagaa

SEQ ID NO: 190777 - DNA, 440 bp, Homo sapiens
  Payload ID: 17688
  Gene Name: thiamin pyrophosphokinase 1
  ENST ID: ENST00000489798
  CDS Start-End: 211-339
ttggcagttaactgccaccaagtggtggttgtatgccatagctctgtaacatgaacagtgtttccaataaactgtccaccgcaaaacccgttaaaaaatgagtgagctccatgagctgaggagctagcagattgccgggattacaaagacaacgagacaggaccctttccttagcaggatttacaatctctcttttaagagcctgtgccgatggaggtgccaaccgcttatatgatatcaccgaaggagagagagaaagctttttgcctgaattcatcaatggagactttgattctattaggcctgaagtcagagaatactatgctactaaggtgttaattttctcaatattgggcacatctttcaaagaagagaaggaacctttctcaggaaggagggaagagaaaaagtcttagaagaacatagcatcaagaatattg

SEQ ID NO: 190778 - DNA, 2860 bp, Homo sapiens
  Payload ID: 17689
  Gene Name: thiamine triphosphatase
  Uniprot ID: Q9BU02
  ENST ID: ENST00000288014
  CDS Start-End: 737-1429
gcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcacttctcaggctttattgggctttatttgtgggagaagggggctggtccccagtttttgcagtgcaaagccagagcgccacctgctggtagccctcaggtgtaggttcgaagctgctggggccccctggggtttgggacacaggagaatttcaggctgtgagtggagacagttactgccacgattccacaggcaagttgttcacctcaaagatctcctgcaccgactggtgaaagtggtcgtaggtgaggcgcagctttagccgcaggggggcctaggaataggagagcagggaccagggttagcacccacggcttcttctatccctgggtcttgtcttgggggaactcctgaagctcaccttgttaggattgaggattctgaagagctgggtgataggaaggccaccccgagctggaactgtgttcccactgggggcctgcagctgcagctggagactctgaacacaggagtttaacagagcacagtatggcagtaggtagggctcaggcagcccctctatactcagtggctccacacccttttcctgtaactccccaagtgctgatctccagatgactcaatcccatctcacactgtctcccacccacctcctccacttagtggccttttctcctggagtccccaggccacctctgaactctgatctttacaaaccttgggcacagcagcct

SEQ ID NO: 190779 - DNA, 1779 bp, Homo sapiens
  Payload ID: 17689
  Gene Name: thiamine triphosphatase
  Uniprot ID: Q9BU02
  ENST ID: ENST00000404535
  CDS Start-End: 353-1045
ggggtgcctggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttc

SEQ ID NO: 190780 - DNA, 1595 bp, Homo sapiens
  Payload ID: 17689
  Gene Name: thiamine triphosphatase
  Uniprot ID: Q9BU02
  ENST ID: ENST00000554789
  CDS Start-End: 465-782
ggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactt

SEQ ID NO: 190781 - DNA, 535 bp, Homo sapiens
  Payload ID: 17689
  Gene Name: thiamine triphosphatase
  Uniprot ID: Q9BU02
  ENST ID: ENST00000556015
  CDS Start-End: 89-406
attcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaag

SEQ ID NO: 190782 - DNA, 339 bp, Homo sapiens
  Payload ID: 17689
  Gene Name: thiamine triphosphatase
  ENST ID: ENST00000556545
  CDS Start-End: 1-182
aactcacagcggaacctacaattgtggcccaactctgtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgag

SEQ ID NO: 190783 - DNA, 581 bp, Homo sapiens
  Payload ID: 17689
  Gene Name: thiamine triphosphatase
  ENST ID: ENST00000557630
  CDS Start-End: 214-581
attacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgac

SEQ ID NO: 190784 - DNA, 569 bp, Homo sapiens
  Payload ID: 17689
  Gene Name: thiamine triphosphatase
  ENST ID: ENST00000554970
  CDS Start-End: 89-511
attcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctggg

SEQ ID NO: 190785 - DNA, 4804 bp, Homo sapiens
  Payload ID: 17690
  Gene Name: thimet oligopeptidase 1
  Uniprot ID: P52888
  ENST ID: ENST00000307741
  CDS Start-End: 204-2273
caggggcgcgtgcgtcctgccctccctgtgcgcgcgccgccccagcatgccccgggagcgcgggcggcgggccccttggtcctcaggcggccgtggcggcggtggcggcggttgggccgaggcaggcggcctcagtggccgaggtggctggacgcgtagcaggtggaaggagggagggagccgcaggcgcagacccacccgccatgaagccccccgcagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaagagagaggctccctggcctggtcactggctcctgcgcttttttggtccgaggacggtgggacggcgggtcagggtccagccctcgggctgttgccacaccaggccctggattggggctcaggtccttgtgggggcggggggtgggggagtaaagggctgggaaccagttctgccagccaggccggcctggggggtctgagagacttcggcttcctgcatgcttctcacctgttgtcattctggaacattccccccgccctgctcagctctggccatcaaggaccaggctccactggtcagagagtctggaaagtcagggcaggccctgtgcgcacaggcagccggggcggggctgggggtcagcagctgcccaccctctcatccacaggggaaggccgggctcactccagcttcctaggcagagtctctgggggttcctgttggacacaagtgaaccaggtgaaccagggcagctgctggaagctcggccatggccctcatcctcatggccttggggactgcctgtgcctgccctccctggcggccccactcccctggctgtgggcaacatggcaaagtcttgatcgggggtgcagggtcgggggggcgcttcctggaccctccaacagtgctcagagatgcctcagggatagctgtcggctgtgtccccacctcccgagcaagacaagtggatgctccccgtctcttcagtcccagtgctctgatgttttctcccgcgactgtgagtttctcaggagcccccctcgtgccctgggagcgtccctccccagtcttagtcctccacgaaggacgctggtcagcagaacctgtgaccctgcttcccgaggcctatgggtggccagacatccgcctcgtcctcacctccatttggacaggactccgagggctgtgccatctgcttcagcccctcctgtcccattcccacccagcccaggtcagtgtggctgtggccactgccatggggcctgctttgcaccttacgcacgcctggctctgctccatgcacctgcttctgtgtctttccaactctgggggctaaggggtgagtcttgtctttgcagagctggacggcacagcctgtggccaggagggttatgccagcgaggcgggaatccataagtgggaacaccacagtggtcacgtttcagatactcacagctcagagcgggtcccatagcttgcacctgaagccccaactactcaggaggctgaggcggaaggattgcttgagcccaggagggcaaggccagcctgggcaacgtggcaagaccccatctctaaaaaaaataagttcggtgggtgtggggccagtgcctgtggtctgttttttgggaggctgaggcaggaggatcgcttgagcctaggaggtcaaggctgcagtaagccgtgatcccaccactgcactgcagcctgggcaacagagcaagactgtctctaaaataacaataataataaaatacctggggttcagaaaagaaaagctggaaggcaaagccgaccgcactgggcagaggtggagatggcaagtctgggggctccctcatcttcccctgccccgagccctcaggtggcctccacctggtccccagcgaagtcccagttgtgcaagagcaccccagctgggccctgggccatcacagccttgtcacacacacagcctggcccatcacagcagagctggggtcacagccttgggctgctgggccgtgggcggatggcctggaccatccacaccccactcccctggaagtcaccaactgggcttagttgccggataccccaggcagccccccgcggtgcttcgcaagttgggccgcctcccccagcatgtcccctgctctgtggacacccagggatgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaataca

SEQ ID NO: 190786 - DNA, 1877 bp, Homo sapiens
  Payload ID: 17690
  Gene Name: thimet oligopeptidase 1
  Uniprot ID: P52888
  ENST ID: ENST00000395212
  CDS Start-End: 779-1555
cttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaag

SEQ ID NO: 190787 - DNA, 671 bp, Homo sapiens
  Payload ID: 17690
  Gene Name: thimet oligopeptidase 1
  ENST ID: ENST00000587468
  CDS Start-End: 164-671
gtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctga

SEQ ID NO: 190788 - DNA, 761 bp, Homo sapiens
  Payload ID: 17690
  Gene Name: thimet oligopeptidase 1
  ENST ID: ENST00000585338
  CDS Start-End: 232-761
ggccgtggcggcggtggcggcggttgggccgaggcaggcggcctcagtggccgaggtggctggacgcgtagcaggtggaaggagggagggagccgcaggcgcagacccacccgccatgaagccccccgcagtagagacggtgctagccaggatgatctccatctcctgacctcgtgatccacccgcctcggcctcccaaagtgctgggattacaggccctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgac

SEQ ID NO: 190789 - DNA, 1104 bp, Homo sapiens
  Payload ID: 17690
  Gene Name: thimet oligopeptidase 1
  ENST ID: ENST00000590970
  CDS Start-End: 1-781
ggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaaga

SEQ ID NO: 190790 - DNA, 702 bp, Homo sapiens
  Payload ID: 17690
  Gene Name: thimet oligopeptidase 1
  ENST ID: ENST00000587401
  CDS Start-End: 1-651
gccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggaagctccacactggcccctcaggcctcgggctgtgagtgctgggagctccgtgtcttcccatacgagtccttccgggatctgcgtgatcggcctcagagccatgggctgagacagacccttctctggagaaggcttggcgtttgccattcatttgctcctc

SEQ ID NO: 190791 - DNA, 639 bp, Homo sapiens
  Payload ID: 17690
  Gene Name: thimet oligopeptidase 1
  ENST ID: ENST00000591363
  CDS Start-End: 1-613
ggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcggcctggtctttgttgcactaacacgtctcctctctgggaaacgtcccttgtcaggagacggctcttctttgaaatgaggtcattaaaaggaaacagaaaaaga

SEQ ID NO: 190792 - DNA, 1872 bp, Homo sapiens
  Payload ID: 17690
  Gene Name: thimet oligopeptidase 1
  ENST ID: ENST00000586677
  CDS Start-End: 60-1766
aagaaactgccaaactgctctttggagcggctgcactggcccacgtcctacatgctttgatgtttttattccaggagaaagttcagaaggactcactgaggcccgaggctgcgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctccaggagctaggagggctccccgaggactttctgaactccctggagaagatggaggacggcaagttgaaggtcaccctcaagtacccccattacttccccctcctgaagaaatgccacgtgcctgagaccaggaggaaagtggaggaggccttcaactgccggtgcaaggaggagaactgcgctatcctcaaggagctggtgacgctgcgggcccagaagtcccgcctgctggggttccacacgcacgccgactatgtcctggagatgaacatggccaagaccagccagaccgtggccaccttcctagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccaggagctcctggggctggccttccaccacgaggagggcgccagtgcctggcatgaggacgtgcggctctacaccgcgagggacgcggcctcgggggaggtggtcggcaagttctacctggacctgtacccgcgggaaggaaagtacgggcacgcggcctgctttggcctgcagcccggctgcctgcggcaggatgggagccgccagatcgccatcgcggccatggtggccaacttcaccaagcccacagccgacgcgccctcgctgctgcagcatgacgaggtggagacctacttccatgagtttggccacgtgatgcaccagctctgctcccaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggca

SEQ ID NO: 190793 - DNA, 2377 bp, Homo sapiens
  Payload ID: 17691
  Gene Name: thioesterase superfamily member 4
  Uniprot ID: Q5T1C6
  ENST ID: ENST00000368814
  CDS Start-End: 351-1073
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgcctgccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaatacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaaaaaaaaaaactcttgtctccttaggatatgttacctgctccactgcagactagagaaataaatgtgtattgaaccttttactgcaaacttgaaaatgctagaaaaccaagcatgaagaataaatacatggtgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattg

SEQ ID NO: 190794 - DNA, 1832 bp, Homo sapiens
  Payload ID: 17691
  Gene Name: thioesterase superfamily member 4
  ENST ID: ENST00000471464
  CDS Start-End: 45-368
cgccgtccagggctagagcaagcgcggccccgcggcccggagccatgctgaggagctgcgccgcgcgcctccgcacgctgggggctctgtgcctgccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttgcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaatacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaaaaaaaaaaactcttgtctccttaggatatgttacctgctccactgcagactagagaaataaatgtgtattgaaccttttactgcaaacttgaaaatgctagaaaaccaagcatgaagaataaatacatggtgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaa

SEQ ID NO: 190795 - DNA, 643 bp, Homo sapiens
  Payload ID: 17691
  Gene Name: thioesterase superfamily member 4
  ENST ID: ENST00000489410
  CDS Start-End: 180-512
cctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgcctgccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagcataaa

SEQ ID NO: 190796 - DNA, 984 bp, Homo sapiens
  Payload ID: 17692
  Gene Name: thioesterase superfamily member 5
  Uniprot ID: Q8N1Q8
  ENST ID: ENST00000368817
  CDS Start-End: 133-876
agcctcgcctagctctctgaaagaaagcctgcaacagaagggagagaagcggccccaagtgcagctgaaagcactccttgggagtcagccaagaccctccatccaagcagggctggatccttgcacttggccatgataaggagatgcttccaggtggcagcaagacttggccaccacagaggccttcttgaggccccccgtatcctgcccagactcaaccctgcctcagcatttggatcctccacagactccatgttctcaagattcttgccagagaagacagacttgaaggattatgctcttcccaatgccagctggtgttcggacatgctgagcctgtaccaagaatttctggagaagactaagtctagcggctggatcaagctgccctccttcaagtccaacagagaccacatccggggactcaagctcccatctggactggcagtttcctcagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaactggacaagattgaggaccagaagctttacatgtcctgcatcgcccacagcagagaccagcagacagtttatgccaagtcctcaggtgttttccttcagctgcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcc

SEQ ID NO: 190797 - DNA, 355 bp, Homo sapiens
  Payload ID: 17692
  Gene Name: thioesterase superfamily member 5
  ENST ID: ENST00000453881
  CDS Start-End: 1-355
gtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaagtgttttccttcagctgcagttggaagaagagtctccccagtaacagtcactgtgcctgcaggagagccactgcctcccctgcctgcctcctgcctcctgcctcccctgcctgcctcctgcctcctgcctccc

SEQ ID NO: 190798 - DNA, 2259 bp, Homo sapiens
  Payload ID: 17693
  Gene Name: thioesterase superfamily member 6
  Uniprot ID: Q8WUY1
  ENST ID: ENST00000336138
  CDS Start-End: 145-771
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaa

SEQ ID NO: 190799 - DNA, 551 bp, Homo sapiens
  Payload ID: 17693
  Gene Name: thioesterase superfamily member 6
  ENST ID: ENST00000520217
  CDS Start-End: 1-251
gggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaagccaccatgggaaagctgcaacctttctgttttatttaaagaaagcccaacattaaagggttttcattgcaa

SEQ ID NO: 190800 - DNA, 3181 bp, Homo sapiens
  Payload ID: 17694
  Gene Name: thiopurine S-methyltransferase
  Uniprot ID: P51580
  ENST ID: ENST00000309983
  CDS Start-End: 87-824
attggtggcggaggcaatggccggcaaccagctgtaagcgaggcacggaagacatatgcttgtgagacaaaggtgtctctgaaactatggatggtacaagaacttcacttgacattgaagagtactcggatactgaggtacagaaaaaccaagtactaactctggaagaatggcaagacaagtgggtgaacggcaagactgcttttcatcaggaacaaggacatcagctattaaagaagcatttagatactttccttaaaggcaagagtggactgagggtattttttcctctttgcggaaaagcggttgagatgaaatggtttgcagaccggggacacagtgtagttggtgtggaaatcagtgaacttgggatacaagaattttttacagagcagaatctttcttactcagaagaaccaatcaccgaaattcctggaaccaaagtatttaagagttcttcggggaacatttcattgtactgttgcagtatttttgatcttcccaggacaaatattggcaaatttgacatgatttgggatagaggagcattagttgccatcaatccaggtgatcgcaaatgctatgcagatacaatgttttccctcctgggaaagaagtttcagtatctcctgtgtgttctttcttatgatccaactaaacatccaggtccaccattttatgttccacatgctgaaattgaaaggttgtttggtaaaatatgcaatatacgttgtcttgagaaggttgatgcttttgaagaacgacataaaagttggggaattgactgtctttttgaaaagttatatctacttacagaaaagtaaatgagacatagataaaataaaatcacactgacatgtttttgaggaattgaaaattatgctaaagcctgaaaatgtaatggatgaatttttaaaattgtttataaatcatatgatagatctttactaaaaatggctttttagtaaagccatttactttttctaaaaaagttttagaagaaaaagatgtaactaaacttttaaagtagctcctttggagaggagattatgatgtgaaagattatgcctatgtgtcttgcagattgcaagatattttaccaatcagcatgtgttacctgtacaattaaaaaaatatttcaaaatgcaatgcatattaaatataatacacacagaaaaactggcatttattttgttttatttttttgagatggagtttcgttcttgttgcccaacctggagtgcaatggtgcaatctcagctcactgcaacctctgcctcccaggttcaggtgattctcctgcctcagcctcctgagtagctgggattacaggtgtgcgccaccacgcccagctaattttttgtatttttagtagagacagggtttcaccatgttggtcaggctgatctcgagctcctgacctcaggtgatctacccacctcggcctcccaaagtgctgggattacaggcgtgagccactgcacctggcctgacattctttatgaaatttagaattgttgaagaactataacatttcagtagggttcaaggtggtcccaaaagttatataaaagattagtttttactataaacccttgtcttttactcagatcctagcatcccttttcacatggtttctccatgtatataacagaatcaagaaacaaattttaattaaacaatctgtaacagaatcaagaaacaaatacattttaattaaacaatctatatggaacaaacattcccaaattctaagaataaatttttctttaagttttctctgagtttggcaattgttgttttttataatttaatctgtttaaatcatcaggtcttataaaatataatgtacttagagctggattcatggctgtttattatgaaaggttagatttctcagttcttctttaaccacattttgttatatcagacagtcctctataactctgtactacccaacaactaaatggtttagattgtttagctcatgttaataggatggttgtgtattataaaaaacgagttacgtgtgtgtgtgcacgcatgcacgcacatgtgctggcttaaaggttgttaatgcaaggtttggggtcccctttaacactggtgaaagctacggtactctccccagagatatgtcttgtcagcctctctagttccccttggcctgcatgtacaaacttctaccctagaagctctctgccatcgatgtattctaatagatttgtaaggctattaatttgaagcaactccttgctcacagtgattcttgcttctctgagacctgctcccagtcgatactgtgggcttcagaagccatgactccccaactctgcctgtatcaccggttgaatggacaactaacccgagctggaccaacacaattctctccagagacttttgattttacttttatgtagagacagggtctcactttgttgcccacgctgatgttgaacttgacgtgaggcctcaagcagtcctcctgtcttggccacccaaagtgctaggattacaggtatgagccattgcgctggccctcttcataggcttttggacttgggaatagaaaagcaaccccgtctctactaaaaatacaaaaaaattagccaggcgtggtggcacgtgcctgtaatcccagctacttgggaggctgaggcaggagaatcacttgaacctaggaggcggaggttgcagtgagctgagatcatgccactgcacgcaagcctgggcaacagagcaagactctgtctcaaaagaaagaaaaagaaaagaaaaaaaagaaaggcaagttgactgctgaaaggggaatctgtgtacgcctgggagctgtggggcagccacattccagcacatggatctgagaaacagaacgctgatctgcagaaagagatgagaaccaaagagaggccacctgcgtcctgggtccattttcatcctccctgaagcccagctgcccagggtggggagaaacaccctgtgtccatgggatagagtcctttccgcttgcagttgtgcccaaagaatcttaaatacaaatgagatatccttaggtagttgatcatttatgtaatatgtgtcttcactggggaatactgacttcctaaaatctcaagatggaagatataccacatgtaaattattttagagcaattaaattgttttcaggattttccaaaaa

SEQ ID NO: 190801 - DNA, 635 bp, Homo sapiens
  Payload ID: 17695
  Gene Name: thioredoxin
  Uniprot ID: P10599
  ENST ID: ENST00000374515
  CDS Start-End: 32-289
tacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtt

SEQ ID NO: 190802 - DNA, 869 bp, Homo sapiens
  Payload ID: 17695
  Gene Name: thioredoxin
  Uniprot ID: P10599
  ENST ID: ENST00000374517
  CDS Start-End: 206-523
ctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgtt

SEQ ID NO: 190803 - DNA, 1736 bp, Homo sapiens
  Payload ID: 17696
  Gene Name: thioredoxin 2
  Uniprot ID: Q99757
  ENST ID: ENST00000216185
  CDS Start-End: 468-968
aaatcccagacgcccctcaaattggagagggacagatgggcgctgtggctcacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccgaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 190804 - DNA, 912 bp, Homo sapiens
  Payload ID: 17696
  Gene Name: thioredoxin 2
  Uniprot ID: Q99757
  ENST ID: ENST00000403313
  CDS Start-End: 199-699
agttcctccttgaattgttgcgtttcatcttttcagacgaccctgggttccagtgttggctgtcatttaatagcggggttactttgggcatgtcacttaacttacttgagcctcgtattccttcccttactcgcagtgtgggcagtacaatagcaacttcctggaagttgctgtaggaagaccaataatgtgtgtaagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtct

SEQ ID NO: 190805 - DNA, 570 bp, Homo sapiens
  Payload ID: 17696
  Gene Name: thioredoxin 2
  ENST ID: ENST00000411915
  CDS Start-End: 34-474
ggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggcagggtctctgtcacccaggctggagtgcagtggcacaatcacagctcactgaagcctcagtctcccaggctcaagcgatcctcctgcctcagcctcccgagtatgggagtacaggtgtcagcggtgcccactgtgctggccatgaaga

SEQ ID NO: 190806 - DNA, 1280 bp, Homo sapiens
  Payload ID: 17696
  Gene Name: thioredoxin 2
  ENST ID: ENST00000416967
  CDS Start-End: 328-522
gtgacgacaggcgtgcccttgacaggcagggagggctaggctgtgcatccctccgctcgcattgcagggaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatc

SEQ ID NO: 190807 - DNA, 3140 bp, Homo sapiens
  Payload ID: 17697
  Gene Name: thioredoxin domain containing 11
  Uniprot ID: Q6PKC3
  ENST ID: ENST00000283033
  CDS Start-End: 149-3025
ggcggaccccgcggcggcggcgcggctgacgtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaatca

SEQ ID NO: 190808 - DNA, 3178 bp, Homo sapiens
  Payload ID: 17697
  Gene Name: thioredoxin domain containing 11
  Uniprot ID: Q6PKC3
  ENST ID: ENST00000356957
  CDS Start-End: 109-3066
cgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagctctggaatcaacctcttctccaagggccctggtttcttttactggagaatggcatttagaaaccaagatctacgtgctagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctagaaaa

SEQ ID NO: 190809 - DNA, 615 bp, Homo sapiens
  Payload ID: 17697
  Gene Name: thioredoxin domain containing 11
  ENST ID: ENST00000575591
  CDS Start-End: 1-615
tacgttcgacgggattcagaggtggtactgctcttcttctatgccccttggtgtggacagtccatcgctgccagggcagaaattgagcaagcagcaagtcggctttcagatcagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtg

SEQ ID NO: 190810 - DNA, 863 bp, Homo sapiens
  Payload ID: 17697
  Gene Name: thioredoxin domain containing 11
  ENST ID: ENST00000576969
  CDS Start-End: 1-444
cggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcac

SEQ ID NO: 190811 - DNA, 581 bp, Homo sapiens
  Payload ID: 17697
  Gene Name: thioredoxin domain containing 11
  ENST ID: ENST00000571882
  CDS Start-End: 1-76
atatctgtatcatcggagcctggagtactcgggtactttgagttcagtggctcaccccagcctcctggttatttgaccttcttcacctcagcattacattcattaaagaaagatggagtctcgccctgccgcccaggctggagtgcagtggcgtgatcttggctcactggaatctgcctcccgggttcaagcgattctcctgcctcagcctcctgagtagctggagttacatagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgt

SEQ ID NO: 190812 - DNA, 2396 bp, Homo sapiens
  Payload ID: 17698
  Gene Name: thioredoxin domain containing 12 (endoplasmic reticulum)
  Uniprot ID: O95881
  ENST ID: ENST00000371626
  CDS Start-End: 1076-1594
agtgctagtggcggcaggtgcaggtggccgcgcggcatcctggggcttgcagtctcccgagcgttctgttgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacattttcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaa

SEQ ID NO: 190813 - DNA, 806 bp, Homo sapiens
  Payload ID: 17698
  Gene Name: thioredoxin domain containing 12 (endoplasmic reticulum)
  ENST ID: ENST00000610127
  CDS Start-End: 96-263
gttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccaggccttattaataaaatggacgggcagtctttcgctgcaggaagatcacattctcctgaggcctataacatttggcataaataactgatgccattatagtctctgtatctcctttctgagaaagctgaacctgggcctagctggcgtagaactcctgtttccatagaaacaagagggtctgtaaaagtcaagggagacaggaagagcagtttgcacttccggcttacgtcggagacgcgtacaacccggaagttggcgcagcgcggttgccaatggtcgctccctgagaggatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccg

SEQ ID NO: 190814 - DNA, 800 bp, Homo sapiens
  Payload ID: 17698
  Gene Name: thioredoxin domain containing 12 (endoplasmic reticulum)
  ENST ID: ENST00000472624
  CDS Start-End: 81-251
gctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccaggattcatgtgtgaaatggaagtctggatgaggcaaactcaaaaggctttttccaaccttcattaagttggttattgattgaattgggtctaaccatggattctggattaccattctaaattgaagtagactgtaaccgtcagaaagaacattggttttggagtcggacttctgagttagctatggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctt

SEQ ID NO: 190815 - DNA, 3548 bp, Homo sapiens
  Payload ID: 17699
  Gene Name: thioredoxin domain containing 15
  Uniprot ID: Q96J42
  ENST ID: ENST00000358387
  CDS Start-End: 626-1708
aggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtcca

SEQ ID NO: 190816 - DNA, 518 bp, Homo sapiens
  Payload ID: 17699
  Gene Name: thioredoxin domain containing 15
  ENST ID: ENST00000509954
  CDS Start-End: 1-346
tttggcactggatgcatctcagcacagcaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaa

SEQ ID NO: 190817 - DNA, 1477 bp, Homo sapiens
  Payload ID: 17699
  Gene Name: thioredoxin domain containing 15
  ENST ID: ENST00000508779
  CDS Start-End: 1-1034
ttttccctggggtgtcctggatggaggcaggacagcagagagttgtggagaaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagca

SEQ ID NO: 190818 - DNA, 1006 bp, Homo sapiens
  Payload ID: 17699
  Gene Name: thioredoxin domain containing 15
  ENST ID: ENST00000511070
  CDS Start-End: 58-192
ctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggagggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggta

SEQ ID NO: 190819 - DNA, 517 bp, Homo sapiens
  Payload ID: 17699
  Gene Name: thioredoxin domain containing 15
  ENST ID: ENST00000506916
  CDS Start-End: 53-517
gctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgac

SEQ ID NO: 190820 - DNA, 579 bp, Homo sapiens
  Payload ID: 17699
  Gene Name: thioredoxin domain containing 15
  ENST ID: ENST00000508810
  CDS Start-End: 42-579
gaccactgtcttaaggaggccagtcttgctcagctccctgcatgaaaaacagacgagaaacacgggagactcccggtaacccccaacttgccgttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcac

SEQ ID NO: 190821 - DNA, 2893 bp, Homo sapiens
  Payload ID: 17699
  Gene Name: thioredoxin domain containing 15
  ENST ID: ENST00000507024
  CDS Start-End: 32-166
gccgtgcgccgattgcctctcggcctgggcaatggtcccggctgccggtcgacgaccgccccgcgtcatgcggctcctcggctggtgttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaa

SEQ ID NO: 190822 - DNA, 4564 bp, Homo sapiens
  Payload ID: 17700
  Gene Name: thioredoxin domain containing 16
  Uniprot ID: Q9P2K2
  ENST ID: ENST00000281741
  CDS Start-End: 373-2850
cgagtcggtggcggctgcaggctgggagggagaagtgctacgcctttgcaggttggcgaagtggttccaggctacccggctagtctggcacggccccgtcttctgcctcctcctccgtcgcgtggcggcgggaactgttggccgcgcggcctcgggaacggcccaggtccccgcccgcaggtcccgggcagataacatagatcatcagtagaaaacttcttgaagttgttcaagaaaaatttgaaagtagcaaaatagaaaataaagaattaacagcagatacagaggacagcatggaagtgttgtcttaggaaacagaacacagcagtgaaaaaacagacaaaatccgctcagatacaactgcagctgataatgttttccggcttcaatgtctttagagttgggatctcttttgtcataatgtgcattttttacatgccaacagtaaactctttaccagaactgagtcctcagaaatattttagtacattgcaaccaggaaaagcctctttagcttatttttgtcaagctgattccccaagaacatctgtatttcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccgcttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccgaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcagtataaaaaagcaatattgacactggtaaagcagaaatacttggattcatttactccatgctggttaaatctaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcgaaatatagaaattattaatgagatattttacatccttttttgtaccaagtcttctaaatgcagtacatattttatacttactgcatttcttacttccgagtagccatatttcaagtgttccttgccacatgtggcctgtgactactgtattggacagttcagtactagacaaaaactagcataattaacttagttctagccatgatttctatttggattaaaattaaactctaatcacagttaactccacagtgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccagggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatatatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaataccttca

SEQ ID NO: 190823 - DNA, 542 bp, Homo sapiens
  Payload ID: 17700
  Gene Name: thioredoxin domain containing 16
  ENST ID: ENST00000557374
  CDS Start-End: 485-542
gagtcggtggcggctgcaggctgggagggagaagtgctacgcctttgcaggttggcgaagtggttccaggctacccggctagtctggcacggccccgtcttctgcctcctcctccgtcgcgtggcggcgggaactgttggccgcgcggcctcgggaacggcccaggtccccgcccgcaggtcccgggcagactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatag

SEQ ID NO: 190824 - DNA, 566 bp, Homo sapiens
  Payload ID: 17700
  Gene Name: thioredoxin domain containing 16
  ENST ID: ENST00000555312
  CDS Start-End: 1-323
ctactatgcttcttactagaataaactgtgcagattggtctgatgtatgtactaagcaaaatgttactgaatttcctatcataaagatgtacaagaaaggcgagaacccagtatcttatgctggaatgttaggaaccgaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacaggtaggaaaaaagtcaatgactaagttgtgaggaaatctgagagccaaagccaagattcaacataaaaatgagatccttaatttctgaagaactgagtactccactttctggctacaactacctacaaacacttacaaaaatggcaaaatgttactaaagcaaaagaagattttagtgaagcaggaaactacctaaaaggatatgttatcactggaatttattctgaagaagatgttttgctactgtcaaccaaatatgctgcaagt

SEQ ID NO: 190825 - DNA, 2219 bp, Homo sapiens
  Payload ID: 17701
  Gene Name: thioredoxin domain containing 17
  Uniprot ID: Q9BRA2
  ENST ID: ENST00000250101
  CDS Start-End: 326-697
aggccctgaactatttaaggatccaggtgttgcaaggcggtaagttttgcagccagtgtccatgaggtcggggctgggactagattagggtagatctaagcctgggcttgggagtgcagctagcgcagaaagatctgaggaactagagcaaaaagccatgcggatggattgtggtcgtcagaggctcccgtagtctttagcggcgctggcttccgcaggctccgccctctcttgcccacccggaaacagcctcgccccgcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttctgggaagaactccaagctgggagtcagtcacactgactctaccacttactagctgtgtaaccacaggcaagttactcaccccgtccaaacctcagttttctcttctataaacaaggttcttagaataaaatgagaattcaaggaagcacttaacatagcacctggtttgtggtacctcccaaatcaatggtagctttcccaaatgaacacaagtatttgaggctcctcatgtttgttctaaagtcaagagtccagttagtaactaaccactagttgtcctgccatgactaggtcaagtgaggccacagtgattcagtgattcttaaagccaccttgcaaagcaggtaatacagttatttcctgtcctgcagaattcaagaacctttatgcagttcctgtcctatgatttaaagaggtcagtgactccgctactctcactacatcttagagtagagtggtagagtagttgatctgagacagtaaggttccaggagatggtcttgccctactatatgtcaggaacagctagccttagaattcagtatacttggtggcccacccctaccccatgccccagtgccttatttggtctaaagcacctaacttttccattcttaatcagctgattatgctaaatgcgtaaaaaagaaaaacaccttacaaatccacagggaaatcaaagaacaattcaggtttaacagaaatagtctattaacaataaaaagttggatgaaaaagcacactaaaggttctaggggctaccataataaaggtagataggaagagttttcattttttttgtcttcactgtacaaaagaaatacattatatacatgtattaagtgcctcgtttgtatccagtttttcattttcccgatgtgttattttgctgttgctgctctgccaaggcttgctgaaggcgcatccgcttccgggaata

SEQ ID NO: 190826 - DNA, 616 bp, Homo sapiens
  Payload ID: 17701
  Gene Name: thioredoxin domain containing 17
  ENST ID: ENST00000574734
  CDS Start-End: 50-277
cgcggcgaccggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttagtaagtggcaatgtataatctacctcgcagacgtgcacaaattgcatacttaggcgggaagggcctcagggacttacttacccagtttgtcttacaagttggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgtt

SEQ ID NO: 190827 - DNA, 459 bp, Homo sapiens
  Payload ID: 17701
  Gene Name: thioredoxin domain containing 17
  ENST ID: ENST00000570330
  CDS Start-End: 68-364
gcctacgcgggacccaaccgcggcgaccggacgtgcactcctccagtagcggctgcacgtcgtgccaatggcccgctatgaggaggtgagcgtgtccggcttcgaggagttccaccgggccgtggaacagcacaatgctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatg

SEQ ID NO: 190828 - DNA, 746 bp, Homo sapiens
  Payload ID: 17701
  Gene Name: thioredoxin domain containing 17
  ENST ID: ENST00000574838
  CDS Start-End: 41-283
cggacgtgcactcctccagtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaagga

SEQ ID NO: 190829 - DNA, 1873 bp, Homo sapiens
  Payload ID: 17702
  Gene Name: thioredoxin domain containing 2 (spermatozoa)
  Uniprot ID: Q86VQ3
  ENST ID: ENST00000306084
  CDS Start-End: 200-1861
gaatgcgtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 190830 - DNA, 2830 bp, Homo sapiens
  Payload ID: 17702
  Gene Name: thioredoxin domain containing 2 (spermatozoa)
  Uniprot ID: Q86VQ3
  ENST ID: ENST00000357775
  CDS Start-End: 236-1696
cctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaagtcccatggtttcctatttttcaatcttgatatgtatttatttttcacttgtctttgaaaatttcacgcatttagtgtttgcagcaagactgaaaatttagataatttttctatagaggtagatgactgaaaggtgaatggaaacttcttttctcatgtcacacatctttggggattctgataagatatgtttggaaataaggaatttgaaagattcacatcttagctaacctccttcttgtgccggaagtgctacggaggccttgggaaattcagtgggttttccaagatctgatttgttggtgacggaaatgagatcaaggccgcttccagatttcaagtccagggctctacctactataatctacgctcacaaaatctcagacaagaggtcggaacttcaggtttctcggaggttgaagtcctctggatctttgctgcctttatgacatcagtgccctgatggcagagttcctggttcgtctccctggtaattgagttcataatacctagaccttcctctgacttttttacttaaatttgttcttattttcaatattgaacaagccagcctttaacatgactctaccagcttagacatataggcctagactttaatgaattaacctaatcacagtgctaccagagtcttgtttggacaacttagtgagccccagatgtctatgagcccaaagtcccaggtctgaaccatagacagaggcttagtccagagtgggtttttaaaaatgaataaaaccagcttcattaggtataattgatatacaaagaacagcacatatttaatggagggagttggatgagtttggatgtgttgcatatgcccttgattgccatctccaccatcaaagtaattaacaccttcattgcctccagaa

SEQ ID NO: 190831 - DNA, 1703 bp, Homo sapiens
  Payload ID: 17702
  Gene Name: thioredoxin domain containing 2 (spermatozoa)
  ENST ID: ENST00000536353
  CDS Start-End: 408-740
gataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggaggggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaag

SEQ ID NO: 190832 - DNA, 571 bp, Homo sapiens
  Payload ID: 17702
  Gene Name: thioredoxin domain containing 2 (spermatozoa)
  ENST ID: ENST00000584255
  CDS Start-End: 322-571
gattcacagaacccaggctggacgggacttgtggcgagcagtccagcacagcctcacagtgcagagcatgagctttggagcctgcccccaccctagctttgtgaccttaagaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatcccca

SEQ ID NO: 190833 - DNA, 2066 bp, Homo sapiens
  Payload ID: 17702
  Gene Name: thioredoxin domain containing 2 (spermatozoa)
  Uniprot ID: Q86VQ3
  ENST ID: ENST00000611534
  CDS Start-End: 450-2066
gtaaagagaatgttggagctgggggatcctggagaaagatgataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaa

SEQ ID NO: 190834 - DNA, 2964 bp, Homo sapiens
  Payload ID: 17703
  Gene Name: thioredoxin domain containing 5 (endoplasmic reticulum)
  Uniprot ID: Q8NBS9
  ENST ID: ENST00000379757
  CDS Start-End: 39-1337
ccggaggccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 190835 - DNA, 1301 bp, Homo sapiens
  Payload ID: 17703
  Gene Name: thioredoxin domain containing 5 (endoplasmic reticulum)
  Uniprot ID: Q8NBS9
  ENST ID: ENST00000473453
  CDS Start-End: 327-1301
aattcaaccgcctcttgcacctcggcaccgagggaggggaaggtggggtcgtcgccctttcgggcagccgggagtccaaatgtcaccccgcggtccctgcccagcgccccaaacttcctgtgccggccggacgcgcggcctgcccgtgggccacgtgcactcaccagagcggccttgctgctgccgcggccaccggggtcggctgggacagactgcgggcacgtccccttccagaggctttaactgaaaaatagaacccaggaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttag

SEQ ID NO: 190836 - DNA, 1787 bp, Homo sapiens
  Payload ID: 17704
  Gene Name: thioredoxin domain containing 8 (spermatozoa)
  ENST ID: ENST00000374507
  CDS Start-End: 52-378
gatccaactaaaccaacaggggattttcatcagcacttccctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgagctggctgaaacttgtcacatcaaaacaatacccacatttcagatgttcaagaaaagccagaagggctccatctccaggcctacaccaaccagtgaactccatccccatcagaaatggacccttgactccagtcaagccaatccaagtcaaaccagagctaatttcaggactttgcttaagcagctaggtaaataaccttctcctttgatatcactggatttgaatttgggaagatatgagtctgaagctactacagcttgtcaccatgtaaaacctgaaaacgaatctaccacacagaagaaaacagagtcaagccaagagtactaatggcattgactgcaccctgaatctatccatgcctgaagcctacactatccccatagattcttcagctatgtaaactctgggttggtttctctgtcacttgcaacccaaaaaattctgatgaacatatctggtgttctcccaggctactctccttcatttcatggtgtaattgttaaaagagtagaatatatttgcagtttccaattctcattttccactcattccctcatctatttatctatttatctttctgtcctctctaaagtcaccaaggatctccctgcacctaatttaaatagccatttctcaattcttgattccttagctacacagaagcaccattaactaatgagcttctatattctggaaattttcttctcttttgactttatctctcatccctccctatgctctcctctggcttgtctcctgttatagtcaaatatatccgttttggatatctatctttttggttcaatccatttcccattctacctctctcctttagcaatgtcattcctacttctagttccatctataaatacttttttacttagacaattgcaatgccccctcctcaccctcaacttagcaccatatctctgttctccagatttgtgcacagctccctgtatggcatccttttttaacatgtgatgtcctccccctccattgcctatagaatcaaggctaaaccattgtatttaaggctggcattcaagtttctccataattttgacccaatctactgctccaagcctttctctgtttaactcagatcttcatgtatttttctcatactagtccaagcacctgaaggaggtcatgtctgatttgaaagctcagtgactagaagaatcccaagtggatagaaaatactcatgatgtgtgtgatgaatgagtgagtgcatgaatgaatgaatgaatgcttctgttttttccctgcatcccactgccagctcagcctctcctcctgattctgtcctggtaccaacctgattcagggcaagtttctctccagttcagtataattttctggttttattcctgctgctgctgatattgtttggtagctgctgccactcaacagtttttactccattttatgatgacacaagactctgagttctcaactgattttgtgtctatgctcttgaaccaattcaagctatgcttttgaggaaaggcatggccctgcttggtctcaattctgtatggggatggaagtgccctcaataagctggggagagaggacatttataaacaattatatctaa

SEQ ID NO: 190837 - DNA, 455 bp, Homo sapiens
  Payload ID: 17704
  Gene Name: thioredoxin domain containing 8 (spermatozoa)
  Uniprot ID: Q6A555
  ENST ID: ENST00000374510
  CDS Start-End: 13-360
cctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgtgtcttgcagatgatggaaatgagtaggatttaacttttcaatcaggaataaaattccttaaagcctcaacattttcgcagcacttgaatcaataaatgtttcacctttgtgcatttgtgaa

SEQ ID NO: 190838 - DNA, 472 bp, Homo sapiens
  Payload ID: 17704
  Gene Name: thioredoxin domain containing 8 (spermatozoa)
  Uniprot ID: Q6A555
  ENST ID: ENST00000374511
  CDS Start-End: 89-472
aggcaggatactgtaataaataggagacagctacagtgatccaactaaaccaacaggggattttcatcagcacttccctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgctatgtctgtgaaataccaaaatgtattttttgctaatgtggatgtgaacaattctccggagctggctgaaacttgtcacatcaaaacaatacccacatttcagatgttcaagaaaagccagaaggtaaccctattctcaagaatcaaaagaataatttgctgttatagaagtggattcatgagcaacctgatttttgagttttgtggagccgatgctaaaaaattggaagccaagactcaagaattaatgtaa

SEQ ID NO: 190839 - DNA, 356 bp, Homo sapiens
  Payload ID: 17704
  Gene Name: thioredoxin domain containing 8 (spermatozoa)
  ENST ID: ENST00000423740
  CDS Start-End: 13-300
cctggtgtaatcatggtacagattattaaagacacgaatgaatttaaaacatttttgacagctgccggacacaaactcgcagtggttcaattttcttcgaaacggtgtggtccctgcaaaaggatgtttcctgttttccatgagctggctgaaacttgtcacatcaaaacaatacccacatttcagatgttcaagaaaagccagaaggtaaccctattctcaagaatcaaaagaataatttgctgttatagaagtggattcatgagcaacctgtgtcttgcagatgatggaaatgagtaggatttaacttttcaatcaggaataaaattccttaaagcctcaacattttcgcagca

SEQ ID NO: 190840 - DNA, 1637 bp, Homo sapiens
  Payload ID: 17705
  Gene Name: thioredoxin domain containing 9
  Uniprot ID: O14530
  ENST ID: ENST00000264255
  CDS Start-End: 257-937
cgggctgctgggcgggaggcgcacgcgcagaactgttcgccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactggaagtttatgtggaaattgtcataaaagcatacatccaacaaaaa

SEQ ID NO: 190841 - DNA, 568 bp, Homo sapiens
  Payload ID: 17705
  Gene Name: thioredoxin domain containing 9
  ENST ID: ENST00000409705
  CDS Start-End: 162-568
acagacaagaataaatatcttgatcactgacacatgctgtacaaataaaattaggaagtcaactctttccatcatgagtaacagaactcaatcgaatgtgacacacagaaatgtctcaaaaatctctagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtga

SEQ ID NO: 190842 - DNA, 1111 bp, Homo sapiens
  Payload ID: 17705
  Gene Name: thioredoxin domain containing 9
  Uniprot ID: O14530
  ENST ID: ENST00000409434
  CDS Start-End: 128-694
gcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacaggtaacttttaacaaaagaagagattgattttaattcatatatagttgatatttttacaaaagatttttgtattgtaacatttattttatgaaattaaggcattttggctgagatgtggaaagtttctcaaaggaaaagcatgtttttttgaagtgtgtaatattagcgtgattttacggcaaaatcagatttacagattaaactgatttaataggtaaaactgagtctcaccgtactcctgactataaaagttttcagcttaacgtatactattgacactaattttgtattaatctggaaacttaaaatggcaatccagtgttgactattccccaatttaagccagattgctcaaatgaattctgacttaagtgattctctttgataaaataaaaattaaaagcagactcttgcaaagaaa

SEQ ID NO: 190843 - DNA, 768 bp, Homo sapiens
  Payload ID: 17705
  Gene Name: thioredoxin domain containing 9
  ENST ID: ENST00000422767
  CDS Start-End: 33-227
cacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgttt

SEQ ID NO: 190844 - DNA, 739 bp, Homo sapiens
  Payload ID: 17705
  Gene Name: thioredoxin domain containing 9
  ENST ID: ENST00000438680
  CDS Start-End: 128-352
gcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagtaacctctctgccctgctttctgaaattgctataacagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacaggtaacttttaa

SEQ ID NO: 190845 - DNA, 733 bp, Homo sapiens
  Payload ID: 17705
  Gene Name: thioredoxin domain containing 9
  ENST ID: ENST00000434323
  CDS Start-End: 180-548
gatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcagcgttgcatatttaggagtaagaagtttttcctcggtaatgctgttcagtttttcttcatgacttccaaatatggcaccatgtgtgcacttctgattcttgtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgg

SEQ ID NO: 190846 - DNA, 1225 bp, Homo sapiens
  Payload ID: 17706
  Gene Name: thioredoxin interacting protein
  Uniprot ID: Q9H3M7
  ENST ID: ENST00000425134
  CDS Start-End: 203-1213
atgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaaga

SEQ ID NO: 190847 - DNA, 2926 bp, Homo sapiens
  Payload ID: 17706
  Gene Name: thioredoxin interacting protein
  Uniprot ID: Q9H3M7
  ENST ID: ENST00000582401
  CDS Start-End: 335-1510
gacgtttccgcctcctgcttgaaactaacccctctttttctccaaaggagtgcttgtggagatcggatcttttctccagcaattgggggaaagaaggctttttctctgaattagcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtgagaatgagatggtgatcatgagacctggaaacaaatatgagtacaagttcggctttgagcttcctcaggggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggcacctgtgtctgctaaaaaagaaaagaaagtttcctgcatgttcattcctgatgggcgggtgtctgtctctgctcgaattgacagaaaaggattctgtgaaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactgatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaa

SEQ ID NO: 190848 - DNA, 4082 bp, Homo sapiens
  Payload ID: 17707
  Gene Name: thioredoxin reductase 1
  ENST ID: ENST00000354940
  CDS Start-End: 702-2198
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgcggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactg

SEQ ID NO: 190849 - DNA, 4277 bp, Homo sapiens
  Payload ID: 17707
  Gene Name: thioredoxin reductase 1
  ENST ID: ENST00000388854
  CDS Start-End: 747-2393
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggtaggtgaggccggcgcctgtaggctggcggtttccttcctcttggtctttgtagagacagtttgcagaacagcggagaaaatggaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgcggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactg

SEQ ID NO: 190850 - DNA, 3832 bp, Homo sapiens
  Payload ID: 17707
  Gene Name: thioredoxin reductase 1
  ENST ID: ENST00000397736
  CDS Start-End: 566-1948
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgcggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactg

SEQ ID NO: 190851 - DNA, 3855 bp, Homo sapiens
  Payload ID: 17707
  Gene Name: thioredoxin reductase 1
  ENST ID: ENST00000429002
  CDS Start-End: 25-1971
agttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgcggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactg

SEQ ID NO: 190852 - DNA, 3930 bp, Homo sapiens
  Payload ID: 17707
  Gene Name: thioredoxin reductase 1
  Uniprot ID: Q16881
  ENST ID: ENST00000503506
  CDS Start-End: 575-2074
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcatt

SEQ ID NO: 190853 - DNA, 577 bp, Homo sapiens
  Payload ID: 17707
  Gene Name: thioredoxin reductase 1
  ENST ID: ENST00000526266
  CDS Start-End: 368-577
gaagaagctaaatcaagcctctgagtttcaccttggaagggcctggcaggacctggcagtggttgcctgtttgtttagagggagtgtggcttctgctggctgttaggagcccgcaacgctctcagctgagagtgcttcaatctggcattatccaaagaacagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatg

SEQ ID NO: 190854 - DNA, 728 bp, Homo sapiens
  Payload ID: 17707
  Gene Name: thioredoxin reductase 1
  ENST ID: ENST00000531691
  CDS Start-End: 312-728
tttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaagagatggaggtctcattatgttgtccaggctggtcttgaactcctgggctcaagcgatcatccggcctcggcctcctaaagtgctgggactgcaggtcacgacatttagtgaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacaggtatg

SEQ ID NO: 190855 - DNA, 557 bp, Homo sapiens
  Payload ID: 17707
  Gene Name: thioredoxin reductase 1
  ENST ID: ENST00000529751
  CDS Start-End: 424-557
ttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggtaggttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccat

SEQ ID NO: 190856 - DNA, 1847 bp, Homo sapiens
  Payload ID: 17707
  Gene Name: thioredoxin reductase 1
  ENST ID: ENST00000526950
  CDS Start-End: 79-1785
actgtcagagtggtgcagtcttgcccccactgttgctggtttccaggtgttctcccttcagtccctgagccactacgtatgcccgccatgctgccaacaggtagccacagtgctgtgcttcctccttcacattgctccaccgcacccccttccacatcccaagaaccttcttcttccgctgaccccaagctctgcctttcaccccctacatctgatagtaggcaagagagaaatgtgcagtttgggctggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatcc

SEQ ID NO: 190857 - DNA, 1933 bp, Homo sapiens
  Payload ID: 17707
  Gene Name: thioredoxin reductase 1
  Uniprot ID: Q16881
  ENST ID: ENST00000524698
  CDS Start-End: 211-1710
aggctggcggtttccttcctcttggtctttgtagagacagtttgcagaacagcggagaaaatggaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggca

SEQ ID NO: 190858 - DNA, 554 bp, Homo sapiens
  Payload ID: 17707
  Gene Name: thioredoxin reductase 1
  ENST ID: ENST00000531689
  CDS Start-End: 339-554
attaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaa

SEQ ID NO: 190859 - DNA, 786 bp, Homo sapiens
  Payload ID: 17707
  Gene Name: thioredoxin reductase 1
  ENST ID: ENST00000527335
  CDS Start-End: 260-786
accttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaata

SEQ ID NO: 190860 - DNA, 629 bp, Homo sapiens
  Payload ID: 17707
  Gene Name: thioredoxin reductase 1
  ENST ID: ENST00000528079
  CDS Start-End: 342-629
agagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaagtgctttgtattgaaggaggaaccttggccataatgccagttgatgactactggctgtgtttaccagcctcttgtgctagaccttttgtgcagactgtcagagtggtgcagtcttgcccccactgttgctggtttccaggtgttctcccttcagtccctgagccactacgtatgcccgccatgctgccaacaggtagccacagtgctgtgcttcctccttcacattgctccaccgcacccccttccacatcccaagaaccttcttcttccgctgaccccaagctctgcctttcaccccctacatctgatagtaggcaagagagaaatgtgcagtttgggctggcttatcaggagggcagacttcaaaagctactaaaaatgaacggccctgaagatcttcccaagtcctatgactatgaccttatcatcattggaggtggctcaggaggtctggcagct

SEQ ID NO: 190861 - DNA, 400 bp, Homo sapiens
  Payload ID: 17707
  Gene Name: thioredoxin reductase 1
  ENST ID: ENST00000526580
  CDS Start-End: 90-400
aggtggtcgagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagc

SEQ ID NO: 190862 - DNA, 3858 bp, Homo sapiens
  Payload ID: 17707
  Gene Name: thioredoxin reductase 1
  ENST ID: ENST00000527688
  CDS Start-End: 360-1808
agtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 190863 - DNA, 3836 bp, Homo sapiens
  Payload ID: 17707
  Gene Name: thioredoxin reductase 1
  Uniprot ID: Q16881
  ENST ID: ENST00000525566
  CDS Start-End: 25-1974
agttcccacagggccttgtgcgacatgggctgcgccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacggccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 190864 - DNA, 2018 bp, Homo sapiens
  Payload ID: 17707
  Gene Name: thioredoxin reductase 1
  Uniprot ID: Q16881
  ENST ID: ENST00000529546
  CDS Start-End: 226-1611
agttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatg

SEQ ID NO: 190865 - DNA, 3808 bp, Homo sapiens
  Payload ID: 17707
  Gene Name: thioredoxin reductase 1
  Uniprot ID: Q16881
  ENST ID: ENST00000526390
  CDS Start-End: 324-1955
tagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggggtaggggacccggaaaccccagggtctggaggagagcaaccaggaagctcttggggtgacttcgttttccttcagagatggaggtctcattatgttgtccaggctggtcttgaactcctgggctcaagcgatcatccggcctcggcctcctaaagtgctgggactgcaggtcacgacatttagtgaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggc

SEQ ID NO: 190866 - DNA, 3974 bp, Homo sapiens
  Payload ID: 17707
  Gene Name: thioredoxin reductase 1
  Uniprot ID: Q16881
  ENST ID: ENST00000526691
  CDS Start-End: 457-2112
acgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataat

SEQ ID NO: 190867 - DNA, 607 bp, Homo sapiens
  Payload ID: 17707
  Gene Name: thioredoxin reductase 1
  ENST ID: ENST00000529784
  CDS Start-End: 449-607
acacaaagcttcagcatgtcatgtggtaggtgaggccggcgcctgtaggctggcggtttccttcctcttggtctttgtagagacagtttgcagaacagcggagaaaatggaggacggtcgggccctggaaggaacgctctcggaattggccgcggaaaccgatctgcccgttgtgtttgtgaaacagagaaagataggcggccatggtccaaccttgaagtgctttgtattgaaggaggaaccttggccataatgccagttgatgactactggctgtgtttaccagcctcttgtgctagaccttttgtgcagactgtcagagtggtgcagtcttgcccccactgttgctggtttccaggtgttctcccttcagtccctgagccactacgtatgcccgccatgctgccaacaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatgg

SEQ ID NO: 190868 - DNA, 1893 bp, Homo sapiens
  Payload ID: 17708
  Gene Name: thioredoxin reductase 2
  ENST ID: ENST00000334363
  CDS Start-End: 2-1018
gatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccatagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttccaggtttaagtcttggtatgtttcttttctttttttttttttttttgagatggagtctcgctctgtcgcccaggctggagtgcagtggcaacctccgcctcccgggttcaagcgattctcctgcctcagcctcctgggtagctggggctacaggcgcccaccactacacctgactaatttttgtatttttagtagagacggggtttcaccatgtaggccaggatggtctcaatctcctgaccttgtgatccacctgccttggcctcccaaagtactgagattacaggtgtgagccaccgcacctggccagtatgtattttttctttagcatattaaatgttttgctgcttcaggctttccagctaggtttttttctttttttgcgtgtgaaacagggtctctctctgttgcctaggaggagtgtggtggtgtgatcatagctcactgcagcctccacctcccaggctcaatcaatcttcccatctcagccttctaagtgctgggattacaggtttgagctactgtgcccagccaagctagtttgttgtttttaacataaaaatgatatggatttgaaagttttaaaaattatggtgacatacacataacatcaaattcatcatcttaagcattttaaagtatatagttcagtggtgttaagtacgttcatattgtacaagcagcatgaccatccatctctagaacttttccattatctccaaactgagctctgtccccattaaacactcactccctgc

SEQ ID NO: 190869 - DNA, 2025 bp, Homo sapiens
  Payload ID: 17708
  Gene Name: thioredoxin reductase 2
  ENST ID: ENST00000400518
  CDS Start-End: 185-1669
ccggacctcaggcccagttcagtgtacttcccctctctacttcctccctccagtcccttctccatccctcccttttttggctgccccttgcctgccttcctcgccagtagcttgcagagtagacacgatgacaccttttgcaggctaaaaaggctgagagtggcactatgtgcagtgagccaccatggaggaccaagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtgtg

SEQ ID NO: 190870 - DNA, 3155 bp, Homo sapiens
  Payload ID: 17708
  Gene Name: thioredoxin reductase 2
  ENST ID: ENST00000400519
  CDS Start-End: 1-1572
atggcggcaatggcggtggcgctgcggggattaggagggcgcttccggtggcggacgcaggccgtggcgggcggggtgcggggcgcggcgcggggcgcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggtatgcaggtggggctggctctgtttgaggacagggcatgtggcaggggtgcaggagccctggccatgggctccctccaggtgtacagcaaggctacacctgccacgccacccagaatgggtgctccatcctgtaaccaggccacagcggtgacaggcagaaggggaagttcccaggggcccaaacctccccgggggaccccagaccccggcctggccacagctgctccccacacacaggaggtatcaagaaacggggctcatccttagcagcctatcccaggtggatgttggcgtggaaggtgtcccgggtgggctaaagtcgggcatctcaagttgctgccccacagggggctgcagtcgggaagctggcctcccaccgaggcctcccaccaaggcctggctcctgcagagttcagcgcccgctcatttccctatctcccagaaggtggagacgctgccctgtgatggccggccctgcccagcctgccctgcacatctggttctgttccagctctgcagagccaggctgaccggggggcatgttgttcatcgtgacctcttctggggaggaagaaactggcaagggctcctggcctctgccccagggatgcctgtgccagagccccctcgcctcgtggtctaatagtgcatcctccggcctgggctgcagggcaggggccggggcagggtgggccctcagcccgtgccatccagcccacctggggcacccccatggctgtcagcccctcccagggttggggtgtttgggctccatctctcccccggggctgaggtggagaccaggcagagcagtgggctccccccaagatgcctgtggacaggctctagggtctgcatggcgccgaggggctctggggaggcctctctgggggtactcagggccccctgcttcaccgtggccgcctccccccggcggggccgcgctcgatagggataaacaaagggcatcctgaggaaactcttatcagaacattacacctcccagagctgttttgttaggagcctgctataaatttttatcatttcaaaatatttttgtagcaccgcgtcgctccctgtgacgcatcgccctggggtggggccattctctgctgggtttatttctcacccatctcccttgggggtccctgggtgtggcagtgggagacatagctaggctgatgtgaggggtgggtggctgacctgtgctgaccttcctgttgttggcaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 190871 - DNA, 2115 bp, Homo sapiens
  Payload ID: 17708
  Gene Name: thioredoxin reductase 2
  Uniprot ID: Q9NNW7
  ENST ID: ENST00000400521
  CDS Start-End: 190-1764
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 190872 - DNA, 1874 bp, Homo sapiens
  Payload ID: 17708
  Gene Name: thioredoxin reductase 2
  ENST ID: ENST00000400525
  CDS Start-End: 18-1523
ccagaagccccacgacgatggcggcaatggcggtggcgctgcggggattaggagggcgcttccggtggcggacgcaggccgtggcgggcggggtgcggggcgcggcgcggggcgcagcagccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 190873 - DNA, 2024 bp, Homo sapiens
  Payload ID: 17708
  Gene Name: thioredoxin reductase 2
  ENST ID: ENST00000542719
  CDS Start-End: 383-1669
gccctgcctaacaccaggcccaccgaaccttgaggtaaagggccagtgacccccatggggacaattaaaggcaaagaattaggtagtaaatttagaggaatggtactacagagatcgaccgccctgctgcctactgtggaggtagacaagcattgtactgagacagaagaagaggctgggacccatctggattggctcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtgt

SEQ ID NO: 190874 - DNA, 751 bp, Homo sapiens
  Payload ID: 17708
  Gene Name: thioredoxin reductase 2
  ENST ID: ENST00000475995
  CDS Start-End: 1-514
cggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccatagggctcccccatcctgctggctgccaggcgggttggccgctccccagtgcacctcgagagcaaccgtgaaggcctgtggggcggcactcacactaggctgtgcccatcttgccatccccagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttc

SEQ ID NO: 190875 - DNA, 810 bp, Homo sapiens
  Payload ID: 17708
  Gene Name: thioredoxin reductase 2
  ENST ID: ENST00000462843
  CDS Start-End: 174-810
tcaagctgcacgtcaggagcacatggaacgctttggggtccctttttagccggggattccagtgaatgaaaacggtagcaggggctcttttgagcttggtcatggggcagccctccgagggcagagtggagggcagcaaacaggagaatgagcaacctacctaggtccttgggatgcccctcaggaggacgagctctagggggaatgctgggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggatggctgcaggccaggtttggggggcctcaaccctctcctggagcgcctgtgagatggtcagcgtggagcgcaagtgctggacaggtggcccgtgtgccccacagggatggctca

SEQ ID NO: 190876 - DNA, 850 bp, Homo sapiens
  Payload ID: 17708
  Gene Name: thioredoxin reductase 2
  ENST ID: ENST00000485358
  CDS Start-End: 76-618
gacgtgcagatcaagctgcacgtcaggagcacatggaacgctttggggtccctttttagccggggattccagtgaatgaaaacggtagcaggggctcttttgagcttggtcatggggcagccctccgaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacc

SEQ ID NO: 190877 - DNA, 2238 bp, Homo sapiens
  Payload ID: 17708
  Gene Name: thioredoxin reductase 2
  ENST ID: ENST00000491939
  CDS Start-End: 87-1007
agacagagggggcacagtgcgaggctgcagggcaggatgacctaacaagggccctgctatggcaacaagaaggacaggcacctgccatggaagcaggtcagcgggactatgatctcctggtggtcggcgggggatctggtggcctggcttgtgccaaggaggccgcccagctgggaaggaaggtggccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccatagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttccaggtttaagtcttggtatgtttcttttctttttttttttttttttgagatggagtctcgctctgtcgcccaggctggagtgcagtggcaacctccgcctcccgggttcaagcgattctcctgcctcagcctcctgggtagctggggctacaggcgcccaccactacacctgactaatttttgtatttttagtagagacggggtttcaccatgtaggccaggatggtctcaatctcctgaccttgtgatccacctgccttggcctcccaaagtactgagattacaggtgtgagccaccgcacctggccagtatgtattttttctttagcatattaaatgttttgctgcttcaggctttccagctaggtttttttctttttttgcgtgtgaaacagggtctctctctgttgcctaggaggagtgtggtggtgtgatcatagctcactgcagcctccacctcccaggctcaatcaatcttcccatctcagccttctaagtgctgggattacaggtttgagctactgtgcccagccaagctagtttgttgtttttaacataaaaatgatatggatttgaaagttttaaaaattatggtgacatacacataacatcaaattcatcatcttaagcattttaaagtatatagttcagtggtgttaagtacgttcatattgtacaagcagcatgaccatccatctctagaacttttccattatctccaaactgagctctgtccccattaaacactcactccctgctgcccgggcactcacccttcactgtgtgtctctatggatctgactcctcgagggacttcatgtaagtagaatcatgcagtgtttgtccttttgtgactggctcatttctcttagcacaatgttttcagggtgcatccatgttgcagcatttgttagagttagcatttgtgtagcatgtgccagcatttccttcctgttgaaggctgagttgtatgtgtgtccattatctgtcagtggacacttaggttgcttccgtcttttggctgttgtggatcatgctgctgtgaacatgggtgtgcacaagccgcctgttttcagcacataaaaatgacacagagtttttaaagttctgtcca

SEQ ID NO: 190878 - DNA, 1129 bp, Homo sapiens
  Payload ID: 17708
  Gene Name: thioredoxin reductase 2
  ENST ID: ENST00000462330
  CDS Start-End: 281-778
ggaatgcgcaggctgcgctctgagtttatctccacggatctctatgcatttctggaatgccaaacaacatctgcatttcctgctgccatggtgattggcagcccatcccagaggacggtgctggaacccccaaggctgggcacaccctgggacggagggatctccagcacagcgacattctgatttggaatttgttatggactgtgacgtgcagatcaagctgcacgtcaggagcacatggaacgctttggggtccctttttagccggggattccagtgaatgaaaacggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 190879 - DNA, 1854 bp, Homo sapiens
  Payload ID: 17708
  Gene Name: thioredoxin reductase 2
  ENST ID: ENST00000474308
  CDS Start-End: 5-1396
gacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggagggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaagtg

SEQ ID NO: 190880 - DNA, 1086 bp, Homo sapiens
  Payload ID: 17708
  Gene Name: thioredoxin reductase 2
  ENST ID: ENST00000634537
  CDS Start-End: 1-1086
cagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccatagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 190881 - DNA, 1131 bp, Homo sapiens
  Payload ID: 17709
  Gene Name: thioredoxin reductase 3
  ENST ID: ENST00000383572
  CDS Start-End: 480-881
gggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtcctctcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgatagactcat

SEQ ID NO: 190882 - DNA, 1134 bp, Homo sapiens
  Payload ID: 17709
  Gene Name: thioredoxin reductase 3
  ENST ID: ENST00000519162
  CDS Start-End: 1-126
gggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtcctctcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgatagactcataca

SEQ ID NO: 190883 - DNA, 2329 bp, Homo sapiens
  Payload ID: 17709
  Gene Name: thioredoxin reductase 3
  ENST ID: ENST00000523403
  CDS Start-End: 112-1935
gtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttatgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatatt

SEQ ID NO: 190884 - DNA, 2950 bp, Homo sapiens
  Payload ID: 17709
  Gene Name: thioredoxin reductase 3
  ENST ID: ENST00000524230
  CDS Start-End: 166-2097
ggtgttggggggcggggcgagcggctgcctcgcggattcgcgcgggtggtgagagtggccagcgagggcagcgttcgccgcccctcaggccccgtcccggcgccgcagccgcctgcgtttcggtttgtgagcaggcccggccgggccaggagcgagagcgagactctggagcggtcgccgccgcagtcgcccgggccgggaaaggcgggcgatgcccccaaccgccgctcgggccatgtccgaggggcgcgcgtgttgtcgccgccggggcgccgtgcccgcctgtcgtcccccgggcccagccgctcgtccgaggcccgcgaggagctgcgccgccacctcgtgggcctcatcgagcgcagccgggtggtgatcttcagcaagagctactgtccccatagtactcgggtgaaagaactcttttcttctttgggagtcgaatgtaatgtcttggaacttgatcaagttgatgatggggccagggttcaagaagtgctgtcagaaatcactaatcagaaaactgtgcccaatattttcgtgaataaagtgcatgtaggtggatgtgaccaaactttccaggcatatcagagtggtttgttacagaagctccttcaggaagatttggcatatgattatgatctcatcatcatcggtggtggttctggaggcctttcatgtgcgaaggaagctgccattttgggaaagaaagttatggtgctagactttgttgtcccgtcacctcagggcacatcctggggtcttggtggcacttgtgtaaatgtaggttgtattcctaagaaattgatgcatcaggctgcccttttggggcaggcattatgtgactcaaggaaatttggctgggaatataatcaacaagtgaggcacaactgggagacaatgacaaaagcgattcagaaccacatcagctctctaaactggggctacaggttgtctctgagggaaaaggctgtggcctatgtcaattcctatggagaatttgttgaacatcataaaataaaggcaaccaataaaaaaggacaggagacttattatactgctgcacagtttgtcatagcaacgggtgaaaggccacggtatttaggaatccaaggagataaagaatactgtattactagtgatgaccttttttctctgccttattgccctggcaaaacattagtggtgggtgcctcttatgttgccctggagtgtgcagggtttctggctggctttggcctagatgtcacagttatggtacgctcaatccttctccgtggcttcgaccaagaaatggcagaaaaagtgggttcctacatggagcagcatggtgtgaagttcctacggaaattcatacctgtgatggttcaacagttggagaaaggttcacctggaaagctgaaagtgttggctaaatccactgaaggaacagaaacaattgaaggagtctataacacagttttgttagctattggtcgtgactcctgtacaaggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagtgtgattatattaatgttccgactacagtgtttactcctctggagtatggttgctgtggattatctgaagagaaagctattgaagtatataaaaaagagaatctagaaatatatcatactttgttctggcctcttgaatggacagtagctggcagagagaacaacacttgttatgcaaagataatctgcaataaattcgaccatgatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctataaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggt

SEQ ID NO: 190885 - DNA, 725 bp, Homo sapiens
  Payload ID: 17709
  Gene Name: thioredoxin reductase 3
  ENST ID: ENST00000518740
  CDS Start-End: 58-309
gaagatcacagtgaaggataatctgatgaaggaacattgacaaatggacagcctagaatgcaccgttaccgtggaaaacgactgcacatcttgcttcccatcttggatcgggtgataggatttcatattcttggaccaaacgccggtgaggttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctataaa

SEQ ID NO: 190886 - DNA, 738 bp, Homo sapiens
  Payload ID: 17710
  Gene Name: thioredoxin reductase 3 neighbor
  Uniprot ID: Q6F5E7
  ENST ID: ENST00000404489
  CDS Start-End: 94-495
tcagattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgata

SEQ ID NO: 190887 - DNA, 6894 bp, Homo sapiens
  Payload ID: 17711
  Gene Name: thioredoxin-like 1
  Uniprot ID: O43396
  ENST ID: ENST00000217515
  CDS Start-End: 206-1075
tcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaatttttgtctttctaaatcagtattttctctttccatgtatttgaaaactggttaacttctgattttagtagagacttaagtgtctggtagtatattgattgaaagccagtttctttagaaaaggagaaactgttctagggaattaagaagtacatgtgtacacattcatggcaagttattttgataagtgaacctggaacagctaaccatgttaaattattactgcatttttattaaaggacatttgtatatctgagctatggaaattactcaaattataaattagaagaaataaacaggtttaatgagatttagctactcttacctaaaacttagctaatgggtccacagattctttcttggtatatatcaagattttaatctcttctggtaaactttaaaatttgagtcagcctttttttttttttttttttttttaactaatagaagaatgtggaaatcagacagttggggaaaaaatacagcatagtgaattcagaaaacaggaattggccaggtgtggtggctaatgtctgtaatcccagtactttgggaggccaaggcgggcgaatcaccagaggtcaggagttcgagtccagcttggccaacatggtgaaacctcgtctctactaaaaatacaaaaattagccaggcatggtggcgggtgtctgtaatcccagctacttgggaggctgagacagaagaatcggctgaacccgggaggcagaggttgcagtgagctgagattgcgccattgcgccccagcctgagcgacaagagcaaaactccgtctccaaaaaaaaaagggaattattacccttaatcaagtatttattacctgaactaccaaaacgtgcagtgtaaatatacagagaacatgatttaaggttgaaaatgaggtgctcaaatagaaatgtttaaaaggtctttcacaaaaggctggtaaaatacctattcgttaccttttttatcttaaaattgtaatctaaaaagtattggtagttttaattttaaaatttctgagtattttgaaaactatttttaaagagtacataagactgtaaaattgtgattcagttaaacatttgagggcattcttgtctaggaatatggtagagataccatttgcctttgtgagagcagtgtgtttatacttgtttatgaaaaaattctacagaagttttagtgttgaaagagtccctttctgaaacccaagtgtcattagatagtttagttcatttgtatatgggcacattaactggtctgtgatgatcttaacactccttaaatagaccatctcagattaatcacatctgaaattaaggataagattaatatgcagggttttggtttacagttttgtacacttaacctttctgagtaattgttaaagtgcctcatcctaagtattgctgaccttttcctatttatacttgatagtttgaaaacccagtgaaacaaatttcgtatttgtaaaggattggacatcagatttatattgtctatgtgactcttctataacaattagttgcagtatgcaagtattacataattcaaattgtaaatagtgaaaaatgaacgtttataggtaactataacgtttcacttaatgggaaatcttactattataaatgtgcataattggcatttaaaatatcaaactgaaatgctgttttctcctaaaacagtatatatatatacacacatatgtatatgtaacatttatatataacactgaattttccagatgaataagagcatttgaaaaaatgtaactctagttattttaactgaagttatttattagtgcatctagaaaactggtattcagtttcttgttcattttgtcggacatagcaaaaaagaatttcatgatctctgtattttgatacattgacatcaggtgcttttgatgagaaacaacagtgaaatatcgtgttcataatagaaacgaaagtcaggtattgcagtaggaagtctttgtcagcttaatgctgaagccaagagtagcacaaggtaccacattcttgtgcccacgacaggcttttataatccttctgagttctctttgacatcaagccccacgttgttccccagtctcaatattctgttggaggcagccacgtaacaattagagttgaaacctgccccacgttgttccccagtctcaatatactgttggaggcagccacgtaacaattagagttgaaacctgccccacgttgttccccagtctcaatatactgttggaggcagccacataacaattagagttgaaacctgccccacgttgttccccagtctcaatattctgttggaggcagccacgtaacaattagagttgaaacctgccccacattgttccccagtctcaatattctgttggaggcagccacgtaacaattagagttgaaacctgccccactttgttccccagtctcaatattctgttggaggcagccacgtaacaattagagttgaaacctgccccacattgttccccagtctcaatattctgttggaggcagccacttaacaattagagttgaaacctgtctgccatcctttgtctcaatgtttgaggatgtatgcagtgtttttggcagcgattataggaatgcagttgtttatttggcctcagcagtttatttatggctgcaattaatatccctgatcatgggcttttaaacctaaaatagttcagatcctcccttgttcctcttaatgtctaaaagctttgattctgtaataagaataaagtgttggagttgaataaattagttacaccctttgtaagctttaaaaacatgaaatttaaggcttactcatgttgcttgtattgatactcatatagttcaatttagtaggttaatttttgtgttaggtatatctcttctggaactgataatttgtaatcttagactattttttttttaagataagtaacttagagtaagaaatccagctgggaacagtggctcatgcctgtaatcccagcattttgggaggccgaggcggctggatcacttgaggtcaggagtttgagaccagcctggctaacatggagaaaccctgtctctactaaaaatacaaaaaattagccaggcatggtggcaggtgccacacccagctacttgggaggctgaggcagtagaatcgcttgaacccgggaggcggaggttgcagtgagccaagatcgcatgactgcacactagcccgggcaacagagtgagactgtctcaaaagaaaaaaaaaaaaaatccattcacagaactgctaaagaaaaactagaggaatattttgctcatttagctttaaaactcattattagaggtgtgtattttacagttttgtaaatatagattatgctttataatacacataaagcaagtatatataacatgcatatagtaaataaattttaaaatattgactattccccagttaagcctatacttcttaaggaagactactgatgtcattttaagcatgtttcaaaattcaagttttatttttgatcaataaggtttttttttttttttaacatgctcagcactataggaataagaggacagtggagatttgtaggctaataagatcgcttttaaactttgtggtccatgtaaaattattagttggagaatgtgtaattagagaactataagataaagagataacctttagaatttgaatgtactaaaattgtacacagcttggaatattaaaatcttaaggatatgcaatgttaaaactgctagagtatttttccttcgtgcttgctatgcttctctatgggaagaggaattttattttggaattatttctaagttgaacagaccagaattaattgtgaaaacatgatctgttggtttataattggacacgcatttggagatactggctcatcatactacctaggagcaaaatctctgaagtttgaatccctgctcttccacttgttagctgtgtcatcttgagcaagtaacatccttcagagctcaaatttcttcttgtgtaaaaataggaacatctatctcttagacttgttctgaagatgcgccttactttgtatctggaacaaggataagtatcttctgtatcctgctctcagctgtcactgctttttaggccatcattacttgcttggcatactgcagtgcctcctaattgtctctttgtttctgctctggcctctctcatgtatcccccacatggccgctggttctcttttctttatggggtctttgtaatgtaatctctcctcctctagcctccccatgcccctcatttctccagtgtgctgtgctgtattaccaggtagcagaacgtaccctaatatcgcatgccttcctctgacctaacttttccatctgaccaattcctacttatctacaaggctcagtccaaggaaaactgataccgggaataatcataacaattgtgcacgcctcctcagctgctatgacaccttgccattatttcatccggatacttatcaagctacttgtaatgatctgtagtcttatttggactactagattgtgagctgtaatacaagtattttgtctctagtattaagccagtttatttggtttctatcattaaatacaatgttgaaaaaattctcagggtccaaggggagatgcttgggttgagtcagagataaagtaggaatatgcagttgaggaaggtaaggaagataatttagctgaagtaaaggaaaagtgcatagtgtgttcatagagtgggagttaagtgtaagagacattctagggaagtgaaggagaagctgaaagagcaagtagagacggtaaggtgaagctcctcttgccatgtgaaagagatcaaactttctccttaatttatgggaggagcgagcatagagaagtctgtgatgtctcacaaggttctcacttttacaattgaatatagaagtagctcttaggagaagcagaacgttcagaggggaagatgaatatggttttgggtacattgccttaaattgcatttttggtatttgggtggcgatgtctagtaagtaaaaagccaggaatgtgattttagagcttagagctagaagcaaggaactaggagttgtttagatgatgaaaactgaaatatgtatatgaatgggaatttttagaatataaagggagagaatgaaactaaggagcaaatgttagggaatcctaagaaatattaaagaattgggaaaagaggaacctggaaggtagagtagtaaacaggaaagggaggaaaaacaggaggtggtaataaagtagtgttaatgaatccaagagggagcagtcaccatcttcaaatgtgatattgaaattagctgggatgtccagttgtttaatccattaaattgtggaaacagtctttctagtgcttaattataggaatcattgatcatattaataaactttcagttgaagcatcagcagataattattccaaaaccctctggcaaagaaatgtagatgcttttatagtctaccattgaacacagttttacatgacacttggcaaaacttggagatggatggcactattttgtaagagaatatgaaacactgctttgaagttgtcattaaaggatcttatcaggtgc

SEQ ID NO: 190888 - DNA, 1339 bp, Homo sapiens
  Payload ID: 17711
  Gene Name: thioredoxin-like 1
  Uniprot ID: O43396
  ENST ID: ENST00000590954
  CDS Start-End: 265-1134
ccaagatggagcgaaggatgaagtagcaagtgcacgtctttcttgggagcaggatgttgcgcaagtttacacttctgaccccatcacactgcttcccactgagatgcaagagaggattcctcatcttccagatgtgcaggctgaaatatttatggatgaaattgtcagatgcctagcatttgctccatgataatctgagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaa

SEQ ID NO: 190889 - DNA, 896 bp, Homo sapiens
  Payload ID: 17711
  Gene Name: thioredoxin-like 1
  ENST ID: ENST00000589329
  CDS Start-End: 815-896
ggagaagcttgaaagcccccttacctgtcacagcttcatctcatgccgcgatgtagcctatcagaccgccggtgggcgccccagccaaggaggacaaggatagggcggaactacggaggatgcggggtgcgtagatcctgctgggataatccgtggggcggcaagcgctatacagccgccgtctccccagtgatactgcaaggtgccggtgccgccgccgccgccactgcagtaaatcagctgacaccagccccaactgccgtgactttcgctgcaactgtcgcaaaaatgagggggcgggaaagactcaccatttccctacttgcaaggcctaagccggcgccgagagagccagccgcgttacgatggagaccgaaagtggagaaaaggccagctgtgggcaaggagtgcacggccgccatcttggttgtgggaagtctcgtctaggctgtcctctctccagttgggaggaccaagatggagcgaaggatgaagtagcaagtgcacgtctttcttgggagcaggatgttgcgcaagtttacacttctgaccccatcacactgcttcccactgagatgcaagagaggattcctcatcttccagatgtgcaggctgaaatatttatggatgaaattgtcagatgcctagcatttgctccatgataatctgagacctgccccgaatacagtacaggagcatcttcaaagtacttccagtgggtgccctggacagcagctaagaaccccgggatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtca

SEQ ID NO: 190890 - DNA, 466 bp, Homo sapiens
  Payload ID: 17711
  Gene Name: thioredoxin-like 1
  ENST ID: ENST00000589931
  CDS Start-End: 1-311
atgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgacacctgtctgctctcacccttcccatgttctcgccattgttggtgcaagatttctacagcttctatcatctggatcagccttgttacctagaaaatacacattggcaagttgagagttatcaacctgtgaaacagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcaga

SEQ ID NO: 190891 - DNA, 934 bp, Homo sapiens
  Payload ID: 17711
  Gene Name: thioredoxin-like 1
  ENST ID: ENST00000587613
  CDS Start-End: 519-934
cttgaaagcccccttacctgtcacagcttcatctcatgccgcgatgtagcctatcagaccgccggtgggcgccccagccaaggaggacaaggatagggcggaactacggaggatgcggggtgcgtagatcctgctgggataatccgtggggcggcaagcgctatacagccgccgtctccccagtgatactgcaaggtgccggtgccgccgccgccgccactgcagtaaatcagctgacaccagccccaactgccgtgactttcgctgcaactgtcgcaaaaatgagggggcgggaaagactcaccatttccctacttgcaaggcctaagccggcgccgagagagccagccgcgttacgatggagaccgaaagtggagaaaaggccagctgtgggcaaggagtgcacggccgccatcttggttgtgggaagtctcgtctaggctgtcctctctccagttgggaggaccaagatggagcgaaggatgaagtagcaagtgcacgtctttcttgggagcaggatgttgcgcaagtttacacttctgaccccatcacactgcttcccactgagatgcaagaggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaa

SEQ ID NO: 190892 - DNA, 2035 bp, Homo sapiens
  Payload ID: 17711
  Gene Name: thioredoxin-like 1
  ENST ID: ENST00000587807
  CDS Start-End: 858-1067
aaggcctaagccggcgccgagagagccagccgcgttacgatggagaccgaaagtggagaaaaggccagctgtgggcaaggagtgcacggccgccatcttggttgtgggaagtctcgtctaggctgtcctctctccagttgggaggaccaagatggagcgaaggatgaagtagcaagtgcacgtctttcttgggagcaggatgttgcgcaagtttacacttctgaccccatcacactgcttcccactgagatgcaagagacctgccccgaatacagtacaggagcatcttcaaagtacttccagtgggtgccctggacagcagctaagaaccccggggtaaaacgagtttcctctctactgttacaaatcagaaacctcctccgtaaaagcctcagatctgggaaacgcggatgcatatgccaacttttgagtctcagtctgcgcctgcgcacgtgacctctacacgtctcctctgcgcctgcgccgctcaagttagcgcgaggctactcagtcgagggtgggactacgcttcgcgttttgggattgggcgctgaaggccaaaccggacgacgcggaaatgacgtcacgccgggggccctgccgcgcggtggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagtacttattcctttgaagataggaagatgttatgttgatgtcattattacagatgtcattatggctgcattagttaagaagagtagcacattattaattgcttcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagctt

SEQ ID NO: 190893 - DNA, 3541 bp, Homo sapiens
  Payload ID: 17711
  Gene Name: thioredoxin-like 1
  ENST ID: ENST00000586262
  CDS Start-End: 1-845
agcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtaagtttgcttaaatgatacttcgggatagtaaaaatataattttaatggaataatttcatgtatctcaactgtcacactttcttttaacaaaataattcaaaattatatcatgtcatgaaattttacaaggctaaactaggatagaaagttcccctaactatatttttagatatccaacaaagtaatctttaataaaaaatgatgtcttaactgataaaagagtcttttaatgaatgacatcaacataagggtaaaaataatggcttggttatagaaagtggttagtaataatggaaaaatgaaagtaaaatcatttgaaagcagttgtgagaattaaataacttagttgatagtaagattctggtgattatttctgatgaaattttaaattacttgaataattttatttaaaaaaaatggactgagttttaatatactgacatgttaactttccaaaccatgtttgtatgctgaaatagcacatttcatcaaataatgatgaacaggcaagttttctgaagtatttttgtatatctttatgtgtgtgcatataattttcttttgaaaagacacaattataaggttagtaaagaattaatagggtacatgggacctttgttaatccagattaattccttctgtacattactggaacgacttctaatgggcaacagttccctagcgtcactcttaaatatacagccagagattatcaaagtgctactgagagctttatcagtacagagcgttagttgctatatactcagtttaaatgtggcagcacagaatacataggtatcccactgtctctaatgattgcatctggcaggcagtctagaacttgaggaagagtttccttaggcctggcaattcctagatgaagaggctcccaagagacccttgttgtggaattgaagatggagaacatcttgagcactctcattctttttggtgcatctacagatcttactttaattcaattatagaaaaatgtattagattgcataacagaggatgatcttacaaaattgtatgctgtttttaccaaattgcaaacctggacaataggtattttaactggttgttttccaattactattttcctgtctcatagcgtgattaccttttggggactgcaggaataattatgcactttagagctgttatgtctagatgtttcacatatgtattatgacaggtcagaagaagcagagattaagcatctacatttttacgatatgaaatatgttttattgggaaaatgtgtgagcaacaaagacgtcttggctgcctgctttacctttttgaattagatgccattggacttggctttaagtgtgccttgtgtggtttattcttaacttagttttttataagatctattactattatcttattattttctcatatcattcattaatttggctctagtttcctgtttcttacctcagtttatgctatttgattttcatttttttctgtaaccaccattctatcttgtttaccttcttaccagctagccattcagttaaagtttctctaatttgcatgaataattatccatctaactatctgcctccacctcgtgtttaacatccccctcacatcccttctagcctagtattttctcttttctgactgtcaaactacgtttttgggggctgtctttaggatagcaaaggtgtaagaccttttttgtttgagagtatttgtgcttgttttataacagccatttattcatttgattttttttaactttaaattaccatatgatagcagttctcaagctttttgatctcaggacctctttatattattaaatactattgaaggccaaaaagaacttttgtttatgtgggctatatttatctgatatttgccatttataagttaaaagtgggaaatataaaaaatatttgtaaataatgaacacatgttaatgaatatttttaaattagaaataagcatattttctaaaagaaaaaccaatttggtaagaagagcattgattcagaattttatgatttttttttttttttttttgagacagggttttgttctgtcacccatgctgcagtgcagaggcacagttatggcttactgcaacctcaaactcctgggctcaagtgatcctccagcctcagcctcacgagtagctgagactacaggcgtgtgccaccacactcggctaatgttttatttttgtgtggggacagggtcttactatgttgcccaggcttctctgtttacgagccttatagtgtcctttccttctcatatctgcttctgcattcagtcagctttcctgtcacacatcatatagcccctggaaaactcccctggatacttgtgaagagaataagagtctaaaaggcaaaaaacgatttagcattatgaaaatagtgttgacctcccagactccttgagagggtcttggagaccacactttgagaactgctacaagaataatttgaataccataatctactcccttgttggtgttctgggcttcttagccccttgcttttaatgtttaataaattttagttgattaagtgattttcttaggtatattaatattgcattttcttgtaatatttctgaatgacatttgtactgtagttattctttgtcttttagggttattctttaaaagtaagctagtatttcattgtttttatattgtacaaagtaacaacttcaatgtagtt

SEQ ID NO: 190894 - DNA, 3504 bp, Homo sapiens
  Payload ID: 17712
  Gene Name: thioredoxin-like 4A
  Uniprot ID: P83876
  ENST ID: ENST00000269601
  CDS Start-End: 202-630
agcacgcacggcgtcggtgcgtgcgcgcccagacgttctgccgggtggcagtcccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaataggagagctattttttattcttcccaagattgtatttgatgtaaacatattttctgtagaagccatggcccttcagttcatatagttagaaaatttccttattggccaggcacggtggctcacacctgtaatcccagcactttgggaggccgaggtgggcagatcacgaagtcaggtgttcgagaccagcctggccaacatggtgaaatcccgtctctactaaaaatacaaaaattagctgggcatggtggcgcgtgcctgtaatcccagctacttggaaggctgaggcaggagaattgcttgaacccgggaggtggaggtttcagtgagccgagatcacaccactgcactccagcctgggcaacagagcaagactccgtctcaaaaaaagaaaagaaaatgtccttattacagtctcaggtttctcttgccctctgtcatcctagcagtgtggatggttggttgggatcttcgtgtcccgtctcagcacactcgagctctgaagtgaaagtgaggaagggcagggatgggggcacttgagcacaccgtgggccctctgacctcagacccaggctctgccccaccaagtgaccttgggcagggtaccttctctgagctttgtttcctccttggtaaaggcggataatagtgtctgccctgcacacagatgtggacgcagaagcacgtggtgcctgccgggcacaggagtggtgcacagggctcgctgctgtcgggagattgattgctgttgtggaaacgggagggtacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcggaatgaggggctagggagaacgtgtatgtgacctcgagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatacaaaaagatcgcaacaagcgtttgcaaggatgtggagaaattggagccctcacacactgctggtggcaaagtggtaacacaggcaggcaggtcgtcaaaaagttaaacatgggccgggtgcaggtgtctcaagcctgtaatcccagcactttggaaggctgagacaggcagattgcttgagcccaggagttcacgaccagcctgggcaacctggtgagaccctgtctctacaaaaaatacagaacaattagctgggcatggtggtgcgtgcctgtgggcccagctactcggcgggctgaggcaggaggatcacttaagccccagaggtcaaggctgcagtaagccatggttgtgccactgcactccagcctgggcaactgagcaagaccctgtctcaaaaaaataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagtactgtaagtgaaaagccagttactacatattgtgtgattccatttatacggaatttctagaataggcacatccatagagacggattagtggttgcttaagactgggagggagggggaaataggaggtgacagctaatgggcagttttatttttgatgtaatgaaaatgtgcttacataagccgagcaggcataaacagaaaaagtgccctaagattgtgataatggtacaattctgtcaattgcataattggtggatgatgtgtgaattatgtctcttaggataacagctttactggcgttaccagaaaaagataaaataattacattccaca

SEQ ID NO: 190895 - DNA, 803 bp, Homo sapiens
  Payload ID: 17712
  Gene Name: thioredoxin-like 4A
  ENST ID: ENST00000355491
  CDS Start-End: 145-420
cggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaagtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcac

SEQ ID NO: 190896 - DNA, 752 bp, Homo sapiens
  Payload ID: 17712
  Gene Name: thioredoxin-like 4A
  ENST ID: ENST00000588162
  CDS Start-End: 150-323
cccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtg

SEQ ID NO: 190897 - DNA, 546 bp, Homo sapiens
  Payload ID: 17712
  Gene Name: thioredoxin-like 4A
  ENST ID: ENST00000592957
  CDS Start-End: 159-374
gcgaagcgagcggcgtgtaagcggggtgaagacaacgccagtcctgaccttggaaggaggatacccaccactggaggctggagccactggaaagaggcgttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagagga

SEQ ID NO: 190898 - DNA, 1185 bp, Homo sapiens
  Payload ID: 17712
  Gene Name: thioredoxin-like 4A
  ENST ID: ENST00000585474
  CDS Start-End: 160-375
gggtgggcagggcgaagactgaagcgagaagggcagcgcgaggtgggcgactaccagagcgaagcgagcggcgtgtaagcggggtgaagacaacgccaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccct

SEQ ID NO: 190899 - DNA, 988 bp, Homo sapiens
  Payload ID: 17712
  Gene Name: thioredoxin-like 4A
  ENST ID: ENST00000585769
  CDS Start-End: 190-354
gtcggtgcgtgcgcgcccagacgttctgccgggtggcagtcccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaatgttaaaaattttgcagttatttatcttgtggatattacagaagtgcctgacttcaacaaaatgtatgagttatacgatccatgtactgtcatgtttttcttcagttaccatagaggttggtgaattagctacatgagcattagaccattctccaaaagtggagcctcctactcggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaata

SEQ ID NO: 190900 - DNA, 706 bp, Homo sapiens
  Payload ID: 17712
  Gene Name: thioredoxin-like 4A
  ENST ID: ENST00000586295
  CDS Start-End: 146-406
gcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaagttctgcaggctgtacaggaagtgtggtactggcatttgcttctggggaggcctcaggaccttccaatcatggcagaaggcaaaggggaacaggcacgtcgcacggtgaaagctggggcggagtgtcacacacttggaacaacctcagctcactaccccgaggacagcaccaagaggatgacgctcaaccattgatgagaaattcatcccatgatccagtcgcctcccaccaggcctcacctgcaacgctgggagttacgtttcaacctgagatttgggcagggacaaatatccaaactatatcaaatggttaaaaattttgcagttatttatcttgtggatattacagaagtgcctgacttcaacaaaatgtatgagttatacgatccatgtactgtcatgtttttct

SEQ ID NO: 190901 - DNA, 586 bp, Homo sapiens
  Payload ID: 17712
  Gene Name: thioredoxin-like 4A
  ENST ID: ENST00000586825
  CDS Start-End: 111-275
tccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtggtggcataaacatcgggtggtgttcagatcctgctgccggcagctcgaggctaggatggctggagatgtgagggcctttgtctcatcacatccgagcacagctcagcaagatgctcttagctagaaaacagattttatgtgttaataaatggcagataatggggactcttccttaccttgttccgagttctgtctggatattccagctgttttaaagttaaaaattttgcagttatttatcttgtggatattacagaagtgcctgacttcaacaaaatgtatgagttatacgatccatgtactgtcatgtttttcttcag

SEQ ID NO: 190902 - DNA, 669 bp, Homo sapiens
  Payload ID: 17712
  Gene Name: thioredoxin-like 4A
  ENST ID: ENST00000591711
  CDS Start-End: 146-457
gcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggtacgttatcttaaagttgttactgaaattgaatattgtcagtttggaagcttaatgtaatcaagatctctttagattattttattttgaaggaagttggttgtacagtcatgtcccaaaatcgtttgtatcaccaggcaatcagtgtgaatctttgaaataattttcaaagtaacaattctagttttagcatttactcagtaacaaattacccttttgaaataactttgcggggaaacctaggtgaagtgtaattcaatgaaagat

SEQ ID NO: 190903 - DNA, 611 bp, Homo sapiens
  Payload ID: 17712
  Gene Name: thioredoxin-like 4A
  ENST ID: ENST00000592837
  CDS Start-End: 277-492
gtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatgg

SEQ ID NO: 190904 - DNA, 2556 bp, Homo sapiens
  Payload ID: 17713
  Gene Name: thioredoxin-like 4B
  Uniprot ID: Q9NX01
  ENST ID: ENST00000268483
  CDS Start-End: 323-772
gagcaaggtgggcggtgactagaagctcttccgtttattgggctgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaatttttttttttttttttgagaccgagtcactcttgtcacccaggctggagtgcagtggcgcgatctcggctcactgcaagctccacctcctgggttcatgccattttcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaagtca

SEQ ID NO: 190905 - DNA, 965 bp, Homo sapiens
  Payload ID: 17713
  Gene Name: thioredoxin-like 4B
  Uniprot ID: Q9NX01
  ENST ID: ENST00000426362
  CDS Start-End: 276-725
gagatcgcccaccagattgcctggtataaatgacactgtgagagagcagaggaagacacaaggagtcctactcgggctcggtgacagtctggggtgggttaaagcggaggcctgggagagggaccaaggccactccaggcagcatccctggatctcagcgaggccgctccaggcagcaggatttgaccagagcaaggaggaaggccaaggcggccaggacggatgcagcatccctgaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttc

SEQ ID NO: 190906 - DNA, 2490 bp, Homo sapiens
  Payload ID: 17713
  Gene Name: thioredoxin-like 4B
  Uniprot ID: Q9NX01
  ENST ID: ENST00000423037
  CDS Start-End: 263-712
acgcccgattcctggatccaagtgtggaacggtacgccaacaggctctcaaggcctcctctggggctctgatcagacacttccgagtctccttgtgaccaatcactcttagcctaagagactacatcccgcctctagtctgggggcaggaaaaggaggggaaaaaggtcgaccatctttaatacgggcggaggtgacgcctagcttccggtcagagccgagcaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaatttttttttttttttttgagaccgagtcactcttgtcacccaggctggagtgcagtggcgcgatctcggctcactgcaagctccacctcctgggttcatgccattttcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcct

SEQ ID NO: 190907 - DNA, 581 bp, Homo sapiens
  Payload ID: 17713
  Gene Name: thioredoxin-like 4B
  ENST ID: ENST00000562153
  CDS Start-End: 229-581
gttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggtggagaagatccagccctcagaagcataaaagctgtccgcagaaccagccctgcaggtactttaggaga

SEQ ID NO: 190908 - DNA, 684 bp, Homo sapiens
  Payload ID: 17713
  Gene Name: thioredoxin-like 4B
  ENST ID: ENST00000565171
  CDS Start-End: 224-397
ctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatatttgtgctgcctccagtatgtgcctgatgcagagagagacctaacccagaactaagacctcttaccgccatttctactgctaccatcccgtctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatg

SEQ ID NO: 190909 - DNA, 546 bp, Homo sapiens
  Payload ID: 17713
  Gene Name: thioredoxin-like 4B
  ENST ID: ENST00000569767
  CDS Start-End: 263-546
acgcccgattcctggatccaagtgtggaacggtacgccaacaggctctcaaggcctcctctggggctctgatcagacacttccgagtctccttgtgaccaatcactcttagcctaagagactacatcccgcctctagtctgggggcaggaaaaggaggggaaaaaggtcgaccatctttaatacgggcggaggtgacgcctagcttccggtcagagccgagcaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatgg

SEQ ID NO: 190910 - DNA, 3995 bp, Homo sapiens
  Payload ID: 17714
  Gene Name: thioredoxin-related transmembrane protein 1
  Uniprot ID: Q9H3N1
  ENST ID: ENST00000457354
  CDS Start-End: 126-968
atgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccgtacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtcactgtagacatctgagtaattaattttcagttagtaacaggcttatagaaactttgggattatttacaaatggtttaggaaagaataaggtatagtaaaagtaatatcctggagaattctgggccacctacccaccataatcaattcagctgtactactgaagtattgtaaaatctgatctctagaggaaaatacagtattctaccttacgttgtgtaaatacttaatgattatcagaaagactgaaaaaagttttaatgaagaattctggctacatctaacagctgccatttaccaagtacctactggagctttgttgttttcttgtatttattaatttagtcctaatgacaactgcaagacaggtaagcattgcacatctttcaggtgagtcagcccagaggtgtggtacaaataggtaaaatttgaatctaattcttgttccaaatctttttttgtttgtttttgtttttgttttttttcttcagtgtgggtacatgaaattcagcaatctcttattttggtcttttttttttttttgagacagagtttcactcttgttgcccaggctggagtgcaatggcatgatcttggctcactgcaacctccacctcctgggttcaagcagttcttctgcctcagcctcccaagtagctgggattacaggcatgtgccaccatgcccggctattattttggtcttaaaatttcactcctgtcagaatgtaggagtgaataaatgctattcataaataaccataattattcagtatttgcagtctcgtgatgttggttattgcataaagtaagttattgcagtaaatgatgctttagaaagcaattttctctcatcagtttcgtccttattcagccttacacaaaaaaaggcatagttctgggcttaattgtgatgtaattaaaattattgagtgaacattttggctcatattttatgacattgtagttcatccccatggtcaatttaaggtagagttcttacaatatattactttcaatataggtattttattaataagaatttatttcagttggacttattaaatgagtggttttgctgagtgtatgagtctataaataaaattttaattgaacatca

SEQ ID NO: 190911 - DNA, 2117 bp, Homo sapiens
  Payload ID: 17714
  Gene Name: thioredoxin-related transmembrane protein 1
  ENST ID: ENST00000556683
  CDS Start-End: 44-361
gggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcagtaagtatttgaagattctaaattatggagaaggatgcattatagtgtaatcagaagtagtaggcctctggcttggatcatgctggaagagctgagttgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccgtacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaa

SEQ ID NO: 190912 - DNA, 1631 bp, Homo sapiens
  Payload ID: 17715
  Gene Name: thioredoxin-related transmembrane protein 2
  Uniprot ID: Q9Y320
  ENST ID: ENST00000278422
  CDS Start-End: 13-903
acggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttga

SEQ ID NO: 190913 - DNA, 1521 bp, Homo sapiens
  Payload ID: 17715
  Gene Name: thioredoxin-related transmembrane protein 2
  Uniprot ID: Q9Y320
  ENST ID: ENST00000378312
  CDS Start-End: 17-793
cgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttga

SEQ ID NO: 190914 - DNA, 829 bp, Homo sapiens
  Payload ID: 17715
  Gene Name: thioredoxin-related transmembrane protein 2
  ENST ID: ENST00000528110
  CDS Start-End: 6-317
aaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgca

SEQ ID NO: 190915 - DNA, 703 bp, Homo sapiens
  Payload ID: 17715
  Gene Name: thioredoxin-related transmembrane protein 2
  ENST ID: ENST00000525035
  CDS Start-End: 8-355
cgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcataggaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcgg

SEQ ID NO: 190916 - DNA, 560 bp, Homo sapiens
  Payload ID: 17715
  Gene Name: thioredoxin-related transmembrane protein 2
  ENST ID: ENST00000533602
  CDS Start-End: 6-260
aaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagctgaatttgaacttggacttctatcccctccctgtctcctatttcaaagtgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatga

SEQ ID NO: 190917 - DNA, 663 bp, Homo sapiens
  Payload ID: 17715
  Gene Name: thioredoxin-related transmembrane protein 2
  ENST ID: ENST00000530114
  CDS Start-End: 13-273
acggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgca

SEQ ID NO: 190918 - DNA, 1697 bp, Homo sapiens
  Payload ID: 17715
  Gene Name: thioredoxin-related transmembrane protein 2
  ENST ID: ENST00000529403
  CDS Start-End: 6-353
aaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttcctt

SEQ ID NO: 190919 - DNA, 696 bp, Homo sapiens
  Payload ID: 17715
  Gene Name: thioredoxin-related transmembrane protein 2
  ENST ID: ENST00000524972
  CDS Start-End: 20-331
ggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccagaggaactagaacgggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgtttttggcttttctttttcttttggccttgattttcacacatggtaaccaaaggcatctccctctcccctcttaaatatctatacttccactttccttgatccattattttttttcagcatattaaataatatattcttttcagatacaactgtacagggctaaattttgggaaggtggatgttggacgctatactgatgttagtacgcggtacaaagtgagcacatcacccctcaccaagcaactccctaccctgatcct

SEQ ID NO: 190920 - DNA, 4927 bp, Homo sapiens
  Payload ID: 17716
  Gene Name: thioredoxin-related transmembrane protein 3
  Uniprot ID: Q96JJ7
  ENST ID: ENST00000299608
  CDS Start-End: 318-1682
accgttttccctagtaaagcccttaagcagggttcccacgctcctgggcgtggaggggggcaccgagagcgcaaaggattcttaagacatgactgcgcaggcgctgtcgcatgcgccgcactcccctcgcatgcgccgcactcccgcgcatagccggagacggagactggccgggtagccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaa

SEQ ID NO: 190921 - DNA, 913 bp, Homo sapiens
  Payload ID: 17716
  Gene Name: thioredoxin-related transmembrane protein 3
  ENST ID: ENST00000443099
  CDS Start-End: 77-670
gggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatggtaagttccaaatctttaactcatgtaaaacattttaaaattaaaatgtctgttatacaacttaggtgtaaagattatgtaaatgcttctactgttcaatgagaataacagttctcatgacttgaatgcctgatgttttgggttttttttcacccttcaacttataattgttagttatttttattctgagctttacctacacaacattctttttgttgttgtttgttaaattatatgcgtttttgaggaataaattctatgtgatttttatacattacttt

SEQ ID NO: 190922 - DNA, 710 bp, Homo sapiens
  Payload ID: 17716
  Gene Name: thioredoxin-related transmembrane protein 3
  ENST ID: ENST00000565918
  CDS Start-End: 89-475
gtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagcttagattccctggaggattgaagattggggtttggccattcttcataggtgaaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgag

SEQ ID NO: 190923 - DNA, 530 bp, Homo sapiens
  Payload ID: 17716
  Gene Name: thioredoxin-related transmembrane protein 3
  ENST ID: ENST00000564008
  CDS Start-End: 85-276
ccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatgcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgag

SEQ ID NO: 190924 - DNA, 1509 bp, Homo sapiens
  Payload ID: 17716
  Gene Name: thioredoxin-related transmembrane protein 3
  ENST ID: ENST00000564631
  CDS Start-End: 97-366
tcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaag

SEQ ID NO: 190925 - DNA, 582 bp, Homo sapiens
  Payload ID: 17716
  Gene Name: thioredoxin-related transmembrane protein 3
  ENST ID: ENST00000569982
  CDS Start-End: 196-405
ctcccgtcagcatggagtgccctcattctcactggggtccgctcacttaacaaccttttagagcccactctgtgtcaggcactgccgtgtaataagtattagagttgcagctcgactttcttcctacgtatctatttgaggggaaatattttgaatggcatttggagtttttacggaagagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaag

SEQ ID NO: 190926 - DNA, 937 bp, Homo sapiens
  Payload ID: 17716
  Gene Name: thioredoxin-related transmembrane protein 3
  Uniprot ID: Q96JJ7
  ENST ID: ENST00000562706
  CDS Start-End: 78-665
cgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgaggtaatatttaaaatttgattttaacgacacaattttatttattaaattattacttgatttaataaactaaattgtgattttattacttgattaaattattgattttaatatcagatttatttactgtgatatgtttggaaaaagtaaacatgctgattctttactactggtattagattgctttttattaataaataccatcagattcgtagcatttagggatttacattagtgcttcttgttttttaaaataaaagtagtgatgacaagtgatacctcaaactcctaaa

SEQ ID NO: 190927 - DNA, 940 bp, Homo sapiens
  Payload ID: 17716
  Gene Name: thioredoxin-related transmembrane protein 3
  ENST ID: ENST00000569053
  CDS Start-End: 55-324
agtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctaattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgataataactacacacttatgctgtcatataaaaggtactatctacatacttgacattttcattttatttacaaagtaatctgtgaggtaggtaataaggcagatagattaataccccaggattacaaaggatatagctaagaatgttagataaggagacaggtgtgtaattaaatagcaggtttatcatatgcttattcagccatccattaattggatgtttattgaatgtctgtattagacgttgggcttataaaagaacttcagagaaacttgtgtatttgaaaatatgagaa

SEQ ID NO: 190928 - DNA, 6169 bp, Homo sapiens
  Payload ID: 17717
  Gene Name: thioredoxin-related transmembrane protein 4
  Uniprot ID: Q9H1E5
  ENST ID: ENST00000246024
  CDS Start-End: 217-1266
ggaggcgggagggggcgtggcctcgacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccggaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctc

SEQ ID NO: 190929 - DNA, 873 bp, Homo sapiens
  Payload ID: 17717
  Gene Name: thioredoxin-related transmembrane protein 4
  ENST ID: ENST00000462384
  CDS Start-End: 34-273
ctccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattatacagatatgtattggaagagaaaggacattcagtgacatccacgtgcagtatgaatacgtagcacaggctaagcaagttacctgttgaagaaattgcagcacggtgaaggcaggccatttgtgtcgtagtcttccgtttgaagacctggagatgtcattgtgagaataaaacataaatatggatgccttttaaattttacagtatgatttcaaataaatgttgatacttattataacttgtaaagttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggt

SEQ ID NO: 190930 - DNA, 787 bp, Homo sapiens
  Payload ID: 17717
  Gene Name: thioredoxin-related transmembrane protein 4
  ENST ID: ENST00000527925
  CDS Start-End: 193-787
gacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctg

SEQ ID NO: 190931 - DNA, 1211 bp, Homo sapiens
  Payload ID: 17718
  Gene Name: thiosulfate sulfurtransferase (rhodanese)
  Uniprot ID: Q16762
  ENST ID: ENST00000249042
  CDS Start-End: 150-1043
ggcggcgcagggtccccctctggcggtggcgcgatggtgcgcgccgcctggggagctgcggccgggggtttgaaccggccaacttctccagccggccggggcgagcgccagcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgagtagtg

SEQ ID NO: 190932 - DNA, 1797 bp, Homo sapiens
  Payload ID: 17718
  Gene Name: thiosulfate sulfurtransferase (rhodanese)
  Uniprot ID: Q16762
  ENST ID: ENST00000403892
  CDS Start-End: 736-1629
gccgggggtttgaaccggccaacttctccagccggccggggcgagcgccagcgcggcgtccggggcgagtgagtgcggggcgggggcagcggccgggcgcctgggccgccggtcgggccacctgctgcccggggaaggatagcgttgcgagagtgggacggggtgccccgggaacccctgatccacctagggcagagggcagcgagctacgggccggactcgggcactctggaggcgggcgagctcgggctgcctggggaggccgcaggcgatggcgtgtgcgcggctcgcggagcttcctagccgtgcgcccaccccctctgccttggaaggaaaggggattctaagcccaagatgccatcgccccccatcccgggcatgctttcattgctctttcctggcgggatcgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgagtagtg

SEQ ID NO: 190933 - DNA, 451 bp, Homo sapiens
  Payload ID: 17718
  Gene Name: thiosulfate sulfurtransferase (rhodanese)
  ENST ID: ENST00000438203
  CDS Start-End: 80-451
ccgcgccacccggcgtccccctcagacccccgcgggtcccggaggccccgcgcgcgaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgta

SEQ ID NO: 190934 - DNA, 1105 bp, Homo sapiens
  Payload ID: 17718
  Gene Name: thiosulfate sulfurtransferase (rhodanese)
  Uniprot ID: Q16762
  ENST ID: ENST00000622841
  CDS Start-End: 44-937
tgtctcttcctggggcctctgggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgagtagtg

SEQ ID NO: 190935 - DNA, 626 bp, Homo sapiens
  Payload ID: 17719
  Gene Name: thiosulfate sulfurtransferase (rhodanese)-like domain containing 1
  Uniprot ID: Q8NFU3
  ENST ID: ENST00000318289
  CDS Start-End: 49-378
gggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 190936 - DNA, 574 bp, Homo sapiens
  Payload ID: 17719
  Gene Name: thiosulfate sulfurtransferase (rhodanese)-like domain containing 1
  Uniprot ID: Q8NFU3
  ENST ID: ENST00000368023
  CDS Start-End: 62-430
gcaggcgccgagagggcgggccagggccgcactccggagactcgcggttgctacgcgcaccatggctggaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 190937 - DNA, 457 bp, Homo sapiens
  Payload ID: 17719
  Gene Name: thiosulfate sulfurtransferase (rhodanese)-like domain containing 1
  Uniprot ID: Q8NFU3
  ENST ID: ENST00000368024
  CDS Start-End: 89-313
cagctctgggagggaacgggagatgttgcaggcgccgagagggcgggccagggccgcactccggagactcgcggttgctacgcgcaccatggctggagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 190938 - DNA, 593 bp, Homo sapiens
  Payload ID: 17719
  Gene Name: thiosulfate sulfurtransferase (rhodanese)-like domain containing 1
  Uniprot ID: Q8NFU3
  ENST ID: ENST00000423014
  CDS Start-End: 102-449
ccggatccggtctcagctctgggagggaacgggagatgttgcaggcgccgagagggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 190939 - DNA, 477 bp, Homo sapiens
  Payload ID: 17719
  Gene Name: thiosulfate sulfurtransferase (rhodanese)-like domain containing 1
  ENST ID: ENST00000466967
  CDS Start-End: 206-394
ggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactggggctcgcaactacgctggagcctatagagaatggttggagaaagagagttaggcaggaggcagcttactgattgccaccccctggccccttaatggccaccttaactaagggtgtgaacgggctgacttggtgaa

SEQ ID NO: 190940 - DNA, 4320 bp, Homo sapiens
  Payload ID: 17720
  Gene Name: thiosulfate sulfurtransferase (rhodanese)-like domain containing 2
  Uniprot ID: Q5T7W7
  ENST ID: ENST00000341170
  CDS Start-End: 384-1934
cgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaa

SEQ ID NO: 190941 - DNA, 1612 bp, Homo sapiens
  Payload ID: 17720
  Gene Name: thiosulfate sulfurtransferase (rhodanese)-like domain containing 2
  ENST ID: ENST00000375165
  CDS Start-End: 1-22
gaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaaggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcaggtaggtcagcacaggctcagagcccaaactgaaatgaagcacattgtcagttcactattctagaaaaatgacacagggaagacaggccagtgctcattactgagcactgaataagcagggaaaataagtacattgtgccaccattttcccagctgtggagctgagagaaccctagcccaggagtcaggaggcctgggttgggatcctggcttcaccattgctagctggacaagcccattaacatggggatcatctcacctgccctgcctgcctgtctacctgccaagagctgtactactgggctaattcagggctcttaacctggaattggtacatagatttcagggattctgtgaatttggatggaaaaataattgtatctttgttttcaataacacctcactaaaatgaagcatttcctttagttatgaatgtaggcaacaaagtaccagttgtattaatgtacctgtgactttgtcttcagtaggattcacaatactttcatatcatgttctagttgcctcagatatctcaaaatagtatttatactcatcactgcttcaaaatgaaaatagttattaggcccaccactaagagttgatatataatgtgttaataaatggcacgtcttattatatattacagattttgaaaaaga

SEQ ID NO: 190942 - DNA, 1503 bp, Homo sapiens
  Payload ID: 17720
  Gene Name: thiosulfate sulfurtransferase (rhodanese)-like domain containing 2
  ENST ID: ENST00000375172
  CDS Start-End: 110-289
aattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctact

SEQ ID NO: 190943 - DNA, 2087 bp, Homo sapiens
  Payload ID: 17721
  Gene Name: THO complex 1
  Uniprot ID: Q96FV9
  ENST ID: ENST00000261600
  CDS Start-End: 9-1982
ccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataaca

SEQ ID NO: 190944 - DNA, 588 bp, Homo sapiens
  Payload ID: 17721
  Gene Name: THO complex 1
  ENST ID: ENST00000581116
  CDS Start-End: 27-287
agtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaagcttagtggtgaagaaaacagactgtggagccagactgcctgggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcag

SEQ ID NO: 190945 - DNA, 2033 bp, Homo sapiens
  Payload ID: 17721
  Gene Name: THO complex 1
  ENST ID: ENST00000580038
  CDS Start-End: 4-759
aagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataaca

SEQ ID NO: 190946 - DNA, 559 bp, Homo sapiens
  Payload ID: 17721
  Gene Name: THO complex 1
  ENST ID: ENST00000581269
  CDS Start-End: 32-397
agcgcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattgtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgg

SEQ ID NO: 190947 - DNA, 815 bp, Homo sapiens
  Payload ID: 17721
  Gene Name: THO complex 1
  ENST ID: ENST00000579891
  CDS Start-End: 1-815
tttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagtgtatgttttgttcacgacagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccg

SEQ ID NO: 190948 - DNA, 536 bp, Homo sapiens
  Payload ID: 17721
  Gene Name: THO complex 1
  ENST ID: ENST00000584642
  CDS Start-End: 1-286
agaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaaggtataagtttttctttttcattaagcataataagaaatggtcttgttttatttccgtttagctgacagcctttctaagttaaactgaatagaaatgtttcttattttactttgggttaaagctgattgattaatgttagtttgaaagtcccatttcttcctttcagaagtaggactaatttggtttcaaaggtgaaagtagttctacattaagtctgttttgtaaactaattttggaataaatgcagtttaattac

SEQ ID NO: 190949 - DNA, 2078 bp, Homo sapiens
  Payload ID: 17721
  Gene Name: THO complex 1
  ENST ID: ENST00000616322
  CDS Start-End: 1-1974
atgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagacagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataac

SEQ ID NO: 190950 - DNA, 1083 bp, Homo sapiens
  Payload ID: 17721
  Gene Name: THO complex 1
  ENST ID: ENST00000621904
  CDS Start-End: 1-1083
tttaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaagtaagttcaacacgcaacaaacccatgattgaaaaaatggaaatttag

SEQ ID NO: 190951 - DNA, 2011 bp, Homo sapiens
  Payload ID: 17721
  Gene Name: THO complex 1
  ENST ID: ENST00000631280
  CDS Start-End: 1-366
atgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattgtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagacgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataac

SEQ ID NO: 190952 - DNA, 5609 bp, Homo sapiens
  Payload ID: 17722
  Gene Name: THO complex 2
  Uniprot ID: Q8NI27
  ENST ID: ENST00000245838
  CDS Start-End: 33-4814
acatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaatggttgt

SEQ ID NO: 190953 - DNA, 4930 bp, Homo sapiens
  Payload ID: 17722
  Gene Name: THO complex 2
  Uniprot ID: Q8NI27
  ENST ID: ENST00000355725
  CDS Start-End: 35-4816
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtaatgcacttaatgctttatgtgagatttaaaaagtattttacccatcttaaataaattgtgtttccatcatagtggatacagtgttcagaccct

SEQ ID NO: 190954 - DNA, 1365 bp, Homo sapiens
  Payload ID: 17722
  Gene Name: THO complex 2
  ENST ID: ENST00000448128
  CDS Start-End: 1-569
gggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaatggttgta

SEQ ID NO: 190955 - DNA, 573 bp, Homo sapiens
  Payload ID: 17722
  Gene Name: THO complex 2
  ENST ID: ENST00000455053
  CDS Start-End: 1-255
ggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactg

SEQ ID NO: 190956 - DNA, 4364 bp, Homo sapiens
  Payload ID: 17722
  Gene Name: THO complex 2
  ENST ID: ENST00000441692
  CDS Start-End: 1-1166
gatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggttacagccatacttcccaaagttcctctgggttctgagaactatgccagctcacctgtcatctccattcattttctacaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaa

SEQ ID NO: 190957 - DNA, 657 bp, Homo sapiens
  Payload ID: 17722
  Gene Name: THO complex 2
  ENST ID: ENST00000416618
  CDS Start-End: 1-543
attgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacagtcctcggacaagcacagataatgaagactttccatcaaggtaatgcacttaatgctttatgtgagatttaaaaagtattttacccatcttaaataaattgtgtttccatcatagtggatacagtgttcagaccct

SEQ ID NO: 190958 - DNA, 876 bp, Homo sapiens
  Payload ID: 17722
  Gene Name: THO complex 2
  ENST ID: ENST00000433883
  CDS Start-End: 16-378
actagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttc

SEQ ID NO: 190959 - DNA, 3188 bp, Homo sapiens
  Payload ID: 17722
  Gene Name: THO complex 2
  ENST ID: ENST00000432353
  CDS Start-End: 1-497
ctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaa

SEQ ID NO: 190960 - DNA, 1137 bp, Homo sapiens
  Payload ID: 17722
  Gene Name: THO complex 2
  ENST ID: ENST00000438358
  CDS Start-End: 1-1137
ggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggtgttgaagtttatcttctgccttcaggagattatgggagattatgcgatcatgtttccacaggctgctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagac

SEQ ID NO: 190961 - DNA, 4452 bp, Homo sapiens
  Payload ID: 17722
  Gene Name: THO complex 2
  ENST ID: ENST00000491737
  CDS Start-End: 1-4437
atgtttgtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagatatcgtctgtatggccagtggaagaatgaaacttataacagtcacccacttttagtaaaagttaaagctcaaacaatagacagagccaaatatatcatgaagcgcctaaccaaggaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatc

SEQ ID NO: 190962 - DNA, 3211 bp, Homo sapiens
  Payload ID: 17722
  Gene Name: THO complex 2
  Uniprot ID: Q8NI27
  ENST ID: ENST00000618150
  CDS Start-End: 80-1324
ttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtg

SEQ ID NO: 190963 - DNA, 1589 bp, Homo sapiens
  Payload ID: 17723
  Gene Name: THO complex 3
  Uniprot ID: Q96J01
  ENST ID: ENST00000265097
  CDS Start-End: 92-1147
ttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcattcttttgctttgtctgtgtattagctctttccattctttgcccccagcatgagttaactcgcgtggactctgcagtgcgagtagtgaccccaccataccttgtcctctggacctcctgtcttctctgcttctgggtgcatggtagactttgtggcatttgatacaacttggacaatacctagtttggagggaggggaatggaagggcatggaagtttttttaaataattaaaaatatatatatataattttgagaattgagcatttaataaactgacttttgttattatggaacttc

SEQ ID NO: 190964 - DNA, 453 bp, Homo sapiens
  Payload ID: 17723
  Gene Name: THO complex 3
  ENST ID: ENST00000432305
  CDS Start-End: 1-227
tggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacagacagagtctcgttctgtcacccagcctggtgtgcagtggttcaagccattctcctgcctcagcctcccaagtagctgggattacaggcgcccaccaccaagcccagctaatttttgtatgttcggtagagacggggtttcaccatgttggccaggctggtctcaaactcctgacctcaagcgacccacccgcctcggcctcccagagttttgcgattacaggcgtgagccaccacgcccagcggaatttcttattctttttgatctatcaaaacaacctcattgttctcaatgactgacc

SEQ ID NO: 190965 - DNA, 602 bp, Homo sapiens
  Payload ID: 17723
  Gene Name: THO complex 3
  ENST ID: ENST00000513006
  CDS Start-End: 61-378
ggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgac

SEQ ID NO: 190966 - DNA, 1796 bp, Homo sapiens
  Payload ID: 17723
  Gene Name: THO complex 3
  Uniprot ID: Q96J01
  ENST ID: ENST00000513482
  CDS Start-End: 73-1056
gcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggtaacttcatgagaatctaccgtctttcacctttggcagtcaggacttctcttgtgatctcatctctgcatgtgactacttcaccagcatgatcatgaatgaatttgtctcctttagacaagtatgtttctgttttgactgtcactgccaggtggtgaggaagcaaagagttaagaaataaacaggcaggtctgaggaaagtgatttagaaaaatattttgatttatttaaactttaaactacagagtagaaggaagaaaaaagcaccacttggggtcccactctctaaataccacctgttttaaatgttgtgatatatttctctttatcttttgcctgtatatgaacttgaaaaaatattatttaaaatttgaggaattataaagtttttgctttaaaaacaacagaagctggaaatagaaaaatgggaggagagtattcattttgcaaaagaatttcctcagatttgttttttaatgttgctttattgtttttggaaatctttgacactcttcgtaaaaagattaaaactgtatagaaaacttcgaagaggaaagtaaagaacttgaaattccactatgtaaagaatgcatgcccctgttagtcacgttgtggtgaacattgtccagcatccagccatgcagatccttcatgtaactgcatgtccctgtgacgcggagacactttcctgctcagtgacctgctcttgagttaacccacctgtgctcagaaccggctctgtcctccactggcttgtgggctctctgtgcctgggggttctctgtaaaatgaggtaatagttgtatctatctcatgggattagtaggtggat

SEQ ID NO: 190967 - DNA, 683 bp, Homo sapiens
  Payload ID: 17723
  Gene Name: THO complex 3
  ENST ID: ENST00000505969
  CDS Start-End: 1-169
gcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcattcttttgctttgtctgtgtattagctctttccattctttgcccccagcatgagttaactcgcgtggactctgcagtgcgagtagtgaccccaccataccttgtcctctggacctcctgtcttctctgcttctgggtgcatggtagactttgtggcatttgatacaacttggacaatacctagtttggagggaggggaatggaagggcatggaagtttttttaaataattaaaa

SEQ ID NO: 190968 - DNA, 628 bp, Homo sapiens
  Payload ID: 17723
  Gene Name: THO complex 3
  ENST ID: ENST00000514861
  CDS Start-End: 42-542
gtaggagtcacctgtggtgagctggaggttggagcctgtagatggcgtggctctgtggctcacttcctgtggttgtggcagtgacagcgatggagactgcagctcgacaggaatgctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcacc

SEQ ID NO: 190969 - DNA, 250 bp, Homo sapiens
  Payload ID: 17723
  Gene Name: THO complex 3
  ENST ID: ENST00000515016
  CDS Start-End: 1-174
catgatgggaaaatgctggcgtcagcatcggaagatcattttattgacattgctgaagtggagacagtccaacagacacactcagcctcccagaaagcagctggccccctggccaagaggccagtttgcagcatcgtgatcattccaccatctttgctgccatttgaatcttgaatcagctttgtgtacctgtaataaattccacttagccatggcatgtagttttttaaaaatacattgttgaatttga

SEQ ID NO: 190970 - DNA, 642 bp, Homo sapiens
  Payload ID: 17723
  Gene Name: THO complex 3
  ENST ID: ENST00000511062
  CDS Start-End: 1-168
gtggttgtggcagtgacagcgatggagactgcagctcgacaggaatggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatc

SEQ ID NO: 190971 - DNA, 649 bp, Homo sapiens
  Payload ID: 17723
  Gene Name: THO complex 3
  ENST ID: ENST00000514250
  CDS Start-End: 1-42
gtggcagtgacagcgatggagactgcagctcgacaggaatgaactacttcctcaagcctaccaccaacgtgctgctccatcgtctatcaccgctgggccttcctcctcagtcaggcaaactggaaggaacatgagagggaatccggaggatggctgcagcaatgcggatgtaggagaccaagatgagcgcacagggagccaggaacaggaccacggcccccaggaacacatgctgattgacatgtatgtgagcaggcaatcttcatgagcaggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaa

SEQ ID NO: 190972 - DNA, 1442 bp, Homo sapiens
  Payload ID: 17723
  Gene Name: THO complex 3
  ENST ID: ENST00000628318
  CDS Start-End: 108-425
agaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcattcttttgctttgtctgtgtattagctctttccattctttgcccccagcatgagttaactcgcgtggactctgcagtgcgagtagtgaccccaccataccttgtcctctggacctcctgtcttctctgcttctgggtgcatggtagactttgtggcatttgatacaacttggacaatacctagtttggagggaggggaatggaagggcatggaagtttttttaaataattaaaaatatatatatataattttgagaattgagcatttaataaactgacttttgttattatgg

SEQ ID NO: 190973 - DNA, 2560 bp, Homo sapiens
  Payload ID: 17724
  Gene Name: THO complex 5
  Uniprot ID: Q13769
  ENST ID: ENST00000397871
  CDS Start-End: 220-2271
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctc

SEQ ID NO: 190974 - DNA, 2676 bp, Homo sapiens
  Payload ID: 17724
  Gene Name: THO complex 5
  Uniprot ID: Q13769
  ENST ID: ENST00000397872
  CDS Start-End: 336-2387
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctc

SEQ ID NO: 190975 - DNA, 2374 bp, Homo sapiens
  Payload ID: 17724
  Gene Name: THO complex 5
  Uniprot ID: Q13769
  ENST ID: ENST00000397873
  CDS Start-End: 224-2275
cccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaag

SEQ ID NO: 190976 - DNA, 738 bp, Homo sapiens
  Payload ID: 17724
  Gene Name: THO complex 5
  ENST ID: ENST00000418021
  CDS Start-End: 459-738
aacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgc

SEQ ID NO: 190977 - DNA, 786 bp, Homo sapiens
  Payload ID: 17724
  Gene Name: THO complex 5
  ENST ID: ENST00000443089
  CDS Start-End: 1-786
gaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgctcatatgaaatcctcccagccccctagacaggataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcagg

SEQ ID NO: 190978 - DNA, 484 bp, Homo sapiens
  Payload ID: 17724
  Gene Name: THO complex 5
  ENST ID: ENST00000414902
  CDS Start-End: 199-330
ggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggct

SEQ ID NO: 190979 - DNA, 1006 bp, Homo sapiens
  Payload ID: 17724
  Gene Name: THO complex 5
  ENST ID: ENST00000440771
  CDS Start-End: 336-1006
gggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaagga

SEQ ID NO: 190980 - DNA, 579 bp, Homo sapiens
  Payload ID: 17724
  Gene Name: THO complex 5
  ENST ID: ENST00000455450
  CDS Start-End: 52-579
ctcatttttctcttgccgccgccacataagaagtgcctttcacctctcgccatgattctgaggcctccccagctatgtgggactgaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcag

SEQ ID NO: 190981 - DNA, 3012 bp, Homo sapiens
  Payload ID: 17724
  Gene Name: THO complex 5
  ENST ID: ENST00000442555
  CDS Start-End: 712-1743
aaaaaatcctgggccttgtttgtacagttcatgccaggggtaggaaatacctgaagctttcaaatactgcgttagagttgtgactctgtcctgggcaagtcaggcctaaaatggagaaactggtgatgcactcctcaaaaagccaagtgtaaaatgaggttaatgccctccctgacttgttgccttcactggcgtggcatattatggtaaaaataataattaagaagtaaggttatgcaggcaaatcctctagcgccgaaatcttccccgccgcgctaccaggttctttcgtgttatcttggacataacacaacattaattcaactactcggtggagcgcccactagctgctggacactctcttaggccctgggcacagtgaacgagaagcatgtgtctttgtttttacagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgctcatatgaaatcctcccagccccctagacaggataagacgttatctgtggcaatcgaaggcagtgtggatgaagccaaggctctgttcaaacctccagaggactcccaagatgacgagagtgactcagatgccgaggaggagcagactacggtgccgtcctccctagaagcagaagaggtgtgaaagaaggtgctgctgggaggggagtctgacaacccagctagctgaagcagcagaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgacc

SEQ ID NO: 190982 - DNA, 729 bp, Homo sapiens
  Payload ID: 17724
  Gene Name: THO complex 5
  ENST ID: ENST00000428374
  CDS Start-End: 245-729
gagctgtgaggtgaggaggggacaagggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagttt

SEQ ID NO: 190983 - DNA, 4753 bp, Homo sapiens
  Payload ID: 17724
  Gene Name: THO complex 5
  Uniprot ID: Q13769
  ENST ID: ENST00000490103
  CDS Start-End: 124-2175
gcttccggtcggccgccccttccttacttccggttctctatggtgcgcgggcaagctttgctccgcctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaccagtggcctttgtctgtggttcctggcaaggtggctttgcagtctggaagggcaggtgggagctgtgacacagtgtgaaaaagcatttgtagagagactttttctcagcagccaataaaagcagagtggaaaaagattccaattctgcagagagatgctcacctcttgtctacgcacaccctatttgtgctttgcggggtgaggtcctcatgatcttgtatttattatcccaagttcctgctgttaagaggtggtaggagaagccaaaggcagcagagcacaaaaagcaaaactcttccctccccacccgctcttcccattagtcctgtcagggttgccgatggacaaattgtctctgatcgttggatgttataaatgtctgacagtgcagtgcaaacagaagacaaactcagttgatccttgaacaactcaggggttaggggcaccaacaccccctgccctgcacagttgaaaaatccgtgtataacttttgactccctaaaaacttaactaatagcctgctgttgaccagtagtatgctattagtagttacttactgctaacatagtcagtacatattttcagtatatattttgtatcttatacactgtattcttacaatacagtaaactagagaaaagaaaatgttataaggaaagtcacaagggggcctgagtgcagtggctcacgtctgtaatcccagcactttgggaggccaaggcgggtggatcacttgaggtcaggagtttgagaccagcctggccgacatggtgaaaccctgtctctactaaaaacatggaaattagccaagcgtggtggcgcatgcctgtagtcccagttactcaggaggctgaggcagaattacttgaacccatgaggcagaggttgcagtaagccaagatcacgctcctgcgctccggcttgggcgagagtgagactccgtctcaaaaataaataaataagaaagccataaggaagaaaatatatatctactattaagtagaagtggatcaccataaaggtcttcacatactgtctcagggttgaatagtctaaggaagaggaggggttggtcttggtgtctcagggatggcagaggcagaaaaagtgggggaggtggagggggaggcaggcaccactgttatttttattgaacaaaatctgtgcagggactcatgactgtaatcctagtactttggaaagctaaggcgggaggatcccttgaggccaggagttcaggtccagcctgggcaacgtagtgagagaccctgtatctacaaaaaatttaaaaatcagccaggtgtggtggtatgcaccaatagtcccagttactcagaaggctgaggtgggcggatgactggagtccaggagttcaaggtagcagtgagctattcatcgtgcctgtactgtactccagcctgggaaacaatgcgagtccctatctctaaaaaattttaaaaaaagaaatctgcatataatagacccacagagtccaaactattgttcagagatcaactgtacttcacagagagtaattctaagtcttacaggatttcatggagatggcgagagtggtgttggagaatcaatcacatacagagatacaggacagtgagaccaggtaacatttgaggagaatattttttttttattgagacagggtcttgctctgttgtccaggctggagtgcagtggcacgaacacagctcactgccgcctcaacctctcctgggttcaagtgatcctcctgcctcagcctcccaagtagctgggaccacaggtgtgtgccaccatttctggctaatttttaaattttttgtagaggcgggatcccactatttttcccaggctggtctcaaactcctgggctcaaatgatcctcccacctcggcctcccaaagtgctaggattataggcatgagccaccacacccggcctgagtagagtctttaaggtaatgacaaaagtgcctcaaaatataattatttgattaagagaagtcttgggaagataggtaacaacctttaaaatgttcataaaattacatcctttgtaatactcctgcaagtcaaagtaaaggatggcatagactattcttggacagttttgtcaaaaagtgtatcttgaccccaccatcagtactccattcttcattttaaaaaataagatgggctgggcacagtggcttacgcctttaatatcagtactttgggaggctggtgggcggatcacctgagatcaggagttcaagaccagcctggccaacatggtgaaaccccgtctctactaaaaatacaaaaattagctgggcatggtggtgcgcgcctgtaatcccagccactcgggaggctgaggcaggagaattgcttgaatccccgaggcggaggttgcactgagccgagatggtgccactgcaccatctggacaacagagcaagactccgtcttgg

SEQ ID NO: 190984 - DNA, 2427 bp, Homo sapiens
  Payload ID: 17724
  Gene Name: THO complex 5
  ENST ID: ENST00000358079
  CDS Start-End: 11-394
aggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggtagtagttaaaaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaaggtaatgtggtggttgggattcgtcccccagggacaccaggtcaccatccaagggcagtcctggtctttggagaactagctggactagttctgtgtagcaggaagcttgacttgaatgtcttagcaccctggagtagacaggaaagagagctcacttcccggagtcacaaggtgcggcccgtggatttcagccctgccactcactagctgactgaccccgaggaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacagttgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctgttttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacct

SEQ ID NO: 190985 - DNA, 1246 bp, Homo sapiens
  Payload ID: 17725
  Gene Name: THO complex 6
  Uniprot ID: Q86W42
  ENST ID: ENST00000253952
  CDS Start-End: 264-1154
agacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggctttttt

SEQ ID NO: 190986 - DNA, 1419 bp, Homo sapiens
  Payload ID: 17725
  Gene Name: THO complex 6
  Uniprot ID: Q86W42
  ENST ID: ENST00000326266
  CDS Start-End: 297-1322
gggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccat

SEQ ID NO: 190987 - DNA, 1300 bp, Homo sapiens
  Payload ID: 17725
  Gene Name: THO complex 6
  Uniprot ID: Q86W42
  ENST ID: ENST00000574549
  CDS Start-End: 249-1202
gcgaggttctgcgcgggcgcggaagacgggcggcgcgtggcggaagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatg

SEQ ID NO: 190988 - DNA, 1360 bp, Homo sapiens
  Payload ID: 17725
  Gene Name: THO complex 6
  Uniprot ID: Q86W42
  ENST ID: ENST00000575576
  CDS Start-End: 342-1295
cgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttcttttttttttttt

SEQ ID NO: 190989 - DNA, 990 bp, Homo sapiens
  Payload ID: 17726
  Gene Name: THO complex 7
  Uniprot ID: Q6I9Y2
  ENST ID: ENST00000295899
  CDS Start-End: 114-728
gcctcctcctccatggctgtttacccggctgcattgtgggagtttgacctccgccgccgccaaccgccgcctcagcttgcgccgccgccgccgccgccgccgccgcgcacgccatgggagccgtgactgacgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgca

SEQ ID NO: 190990 - DNA, 836 bp, Homo sapiens
  Payload ID: 17726
  Gene Name: THO complex 7
  ENST ID: ENST00000469584
  CDS Start-End: 117-575
gtgggagtttgacctccgccgccgccaaccgccgcctcagcttgcgccgccgccgccgccgccgccgccgcgcacgccatgggagccgtgactgacgatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgc

SEQ ID NO: 190991 - DNA, 459 bp, Homo sapiens
  Payload ID: 17726
  Gene Name: THO complex 7
  ENST ID: ENST00000464327
  CDS Start-End: 280-459
gcgcacgccatgggagccgtgactgacgggaagaaaggcaattcagacaaagcagactgaatatttagtagtagattgtaaatattcaggcaaagaaagagagagagaggcagtaggagttacatcagttttaccatccttgacgaagttatacggaagcgtctcctcattgatggagatggtgctggagatgatcggagaattaatctgctagtgaagagtttcattaaatggtgcaactctgggtcccaggaagagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaata

SEQ ID NO: 190992 - DNA, 490 bp, Homo sapiens
  Payload ID: 17726
  Gene Name: THO complex 7
  ENST ID: ENST00000469153
  CDS Start-End: 1-92
acgaagttatacggaagcgtctcctcattgatggagatggtgctggagatgatcggagaattaatctgctagtgaagagtttcattaaatgatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagca

SEQ ID NO: 190993 - DNA, 629 bp, Homo sapiens
  Payload ID: 17727
  Gene Name: three prime repair exonuclease 1
  ENST ID: ENST00000456089
  CDS Start-End: 57-584
ggagagtgtgcagccgagtcactactgcctgcctgcctgcctgctacgagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 190994 - DNA, 1105 bp, Homo sapiens
  Payload ID: 17727
  Gene Name: three prime repair exonuclease 1
  ENST ID: ENST00000433541
  CDS Start-End: 533-1060
gcctgtggaattgtcctgagtcattgctttgggctggggccatgggaagaaaccattgtgtggcagggaaggaggtggctcttggcccaggcctaaaccaggaaagcctgggaaactgggacccacagcgagagccgcgggagagtgtgcagccgagtcactactgcctgcctgcctgcctgctacggctcagcagcagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 190995 - DNA, 1200 bp, Homo sapiens
  Payload ID: 17727
  Gene Name: three prime repair exonuclease 1
  Uniprot ID: Q9NSU2
  ENST ID: ENST00000444177
  CDS Start-End: 243-1157
tgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgcccca

SEQ ID NO: 190996 - DNA, 1426 bp, Homo sapiens
  Payload ID: 17727
  Gene Name: three prime repair exonuclease 1
  Uniprot ID: Q9NSU2
  ENST ID: ENST00000629913
  CDS Start-End: 482-1426
ggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtag

SEQ ID NO: 190997 - DNA, 1783 bp, Homo sapiens
  Payload ID: 17727
  Gene Name: three prime repair exonuclease 1
  Uniprot ID: Q9NSU2
  ENST ID: ENST00000625293
  CDS Start-End: 629-1738
ccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 190998 - DNA, 2262 bp, Homo sapiens
  Payload ID: 17728
  Gene Name: three prime repair exonuclease 2
  Uniprot ID: Q9BQ50
  ENST ID: ENST00000330912
  CDS Start-End: 1552-2262
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagctgggggcgggctgcggccgctgattaaaggccgcctagagcagcctgtgtggcgacaggtgcccagaagcccaggaagccggtcagtgcccgccccagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 190999 - DNA, 1982 bp, Homo sapiens
  Payload ID: 17728
  Gene Name: three prime repair exonuclease 2
  Uniprot ID: Q9BQ50
  ENST ID: ENST00000334497
  CDS Start-End: 1143-1982
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191000 - DNA, 2116 bp, Homo sapiens
  Payload ID: 17728
  Gene Name: three prime repair exonuclease 2
  Uniprot ID: Q9BQ50
  ENST ID: ENST00000338525
  CDS Start-End: 1406-2116
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191001 - DNA, 861 bp, Homo sapiens
  Payload ID: 17728
  Gene Name: three prime repair exonuclease 2
  Uniprot ID: Q9BQ50
  ENST ID: ENST00000370212
  CDS Start-End: 22-861
tggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191002 - DNA, 1255 bp, Homo sapiens
  Payload ID: 17728
  Gene Name: three prime repair exonuclease 2
  Uniprot ID: Q9BQ50
  ENST ID: ENST00000370231
  CDS Start-End: 545-1255
caccttggtcacactccagagctcgcttcatccccacgagcggcacctgatctccagtgacggggagactgaggcctggcaaagaggacctgttgcctttgtgtaactggccccagcatgggggaggcattggccccagcatgggggaggcattgaccccaggcctgccaggcctggcagccacagcctggctaggtggaggttactgccttccgcaccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191003 - DNA, 1864 bp, Homo sapiens
  Payload ID: 17728
  Gene Name: three prime repair exonuclease 2
  Uniprot ID: Q9BQ50
  ENST ID: ENST00000370232
  CDS Start-End: 1025-1864
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191004 - DNA, 907 bp, Homo sapiens
  Payload ID: 17728
  Gene Name: three prime repair exonuclease 2
  Uniprot ID: Q9BQ50
  ENST ID: ENST00000393862
  CDS Start-End: 197-907
tggcctacgccaaagcacaggatggggcgggcaggaagccctctcccaagatcgagttggccgaggatggatgattgtggcagcagaagccgttgcagccccacgttgtgctctagtaggtgacaggagtggggctgacgctcccagagccaaaggtcacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 191005 - DNA, 3691 bp, Homo sapiens
  Payload ID: 17729
  Gene Name: threonine synthase-like 1
  Uniprot ID: Q8IYQ7
  ENST ID: ENST00000376356
  CDS Start-End: 251-2482
actgcgcgggggcgggaccggggagctagctgcagactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggagtacagtagcattttgtcttttatgtaaatatctctatatctgtttggaatttcaaaagtctgatctctagggctgacatgagaactccatgtcacctcctcagatctttaatctggaagtgacaaaaggtaacacagtgcacggacctttgagctatcatacttttgccttctgctcatgaggggtgtatcaatttccactcccacaccctcactgttatgtggaccaaaatgtctggtatactatttggcgattaaaatatttaagcccagttttcaggtactacatctgtaactagtgaatactctgttgattagaaagttaatttaccactcaaaatggctaacttgaatggaggaagtagtaaactcttctattaggatttgggccagtgttttttgtttgttttttggtgcagtttcagctcactgcaacctccgcctcccaggttcaagtgattctcctgcctcagcctcccaggtagctgggattacaggcatgcaacaccacacatggctaatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaa

SEQ ID NO: 191006 - DNA, 3788 bp, Homo sapiens
  Payload ID: 17729
  Gene Name: threonine synthase-like 1
  Uniprot ID: Q8IYQ7
  ENST ID: ENST00000524413
  CDS Start-End: 348-2579
actgcgcgggggcgggaccggggagctagctgcaggtacggtgctccgtctcctgtggaggctttagcggctcgtggacactgctcccccatttcctttcatttcccccgtcttctcagtgagatttccttgactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggagtacagtagcattttgtcttttatgtaaatatctctatatctgtttggaatttcaaaagtctgatctctagggctgacatgagaactccatgtcacctcctcagatctttaatctggaagtgacaaaaggtaacacagtgcacggacctttgagctatcatacttttgccttctgctcatgaggggtgtatcaatttccactcccacaccctcactgttatgtggaccaaaatgtctggtatactatttggcgattaaaatatttaagcccagttttcaggtactacatctgtaactagtgaatactctgttgattagaaagttaatttaccactcaaaatggctaacttgaatggaggaagtagtaaactcttctattaggatttgggccagtgttttttgtttgttttttggtgcagtttcagctcactgcaacctccgcctcccaggttcaagtgattctcctgcctcagcctcccaggtagctgggattacaggcatgcaacaccacacatggctaatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaa

SEQ ID NO: 191007 - DNA, 3649 bp, Homo sapiens
  Payload ID: 17730
  Gene Name: threonine synthase-like 2
  Uniprot ID: Q86YJ6
  ENST ID: ENST00000324166
  CDS Start-End: 1692-3146
attttctttcgctgtaccttactgccttgctcgctcctgccctcactcctgcgatggtttctttggcagctcagtcgtagcgtttaagtctggtcctatgaaggcctttctgttactccacggtcttgggcagtttgcgttggctctaactcttaccacagaattgcagaaattcctctctttattgagggcaccgctagcacctgccccccgaccctggttctgttttgtgaaatactgcctgctttgcttatccactgcagttaacttttggagttacccatatttcatctctttgacatggactcccatacggagtgaccttgtatcctaggttgccagagagagagttctggcttataccattgtcccagcataatcactttcaaaagattcatggtttgtatgatcaagtttgtctctgtctctaagtgagatacacttaatatttgtagttaagagagtggcacgtggcagcccacgtgagacttgcacgggggcccacagatgtcagagccacagactaggaaatgagaattcctccaggtcagtgctcatatgcctcatgtaggtagagagctttgggtggctttgcccttagagggcaggggatcccctcccaccctggcacagaaagtccaagctaatactgagagctatgtctagtcaaattcatccccatagttactgtggggcgtcaaagccagggcccctaaattcactgtcatgatccagaagaaggtgttcagagttcaagcccagctccttgacatggcatctggctcctgggaaagtaactgatgtggaagtgtgaccagtgttaggcctaaggggtcctgggcttccccaggaaccagagaactcagtccatgcagggccagttagttttaaagactgcatatcagcacttataacggtcctaggattaggctaagaggtagaacactggttatccactaggatgaccaaccatcttagtttgcctgggattgaggggtttcctaggacatgggacttgcagttttaagaccagaaaactcctgggcgaactgggatgagttggtcaccctcttctcaaccctggctgcacgttagactctcttgaggagcctctcatttagagtctaatttaattgattcaggtagttgtattttttttaacgctctgaggttgattccaacaagctaccacagttgagaactactaggctgtagacagtgtttccaataaccattgaagatgtttggtttttgagcagaagtggaccgagacgtccctgaaaggggtgtatgactctgtgcgttggtctttcgccttagcaagagggatatcaagctggcagttgcctactattgctattatctgtccccaccgccaggccttctttctcattggtgaggaccaagctttctcttttcccggcatgctccgataccctctccctgaagacaggaggtcagtggaattgcctcattttgattggtggaatcatgatttacacagttgtagatgaagctggcatgagacttgatacaggactgccatctctaggtctgggacatgtgccccggagactggtggtctagaggctaactgtgagactgtgtgtgctttggctttgcccggtggggtgtgggagcttggagaccaggtgcttctgggactgtcctctctgcaggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtg

SEQ ID NO: 191008 - DNA, 2052 bp, Homo sapiens
  Payload ID: 17730
  Gene Name: threonine synthase-like 2
  Uniprot ID: Q86YJ6
  ENST ID: ENST00000343544
  CDS Start-End: 72-1289
tgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagtgggagagacaggactacgaaaaaatggctgtaatggagtgtgatgggtgctgtgtggaactgtgccttggaaactgtgggcccagaagagggagcgtgacagatatcccagggacagccatggtcagaggtggtggctgagctggcctccaaccaggaggagcagtttgccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 191009 - DNA, 1560 bp, Homo sapiens
  Payload ID: 17730
  Gene Name: threonine synthase-like 2
  ENST ID: ENST00000377254
  CDS Start-End: 219-899
cactgcgaagctgagaaccctagctccggccccgaccggaagccccaccgcaccgtcagggacgcggactcgggagtgcgcacattcgcagcccgggcagccctgctgcgcaccgggcctcgcgccccgcgccccgcgccccgcgccccgcgccccgcaccggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgatggagcggc

SEQ ID NO: 191010 - DNA, 577 bp, Homo sapiens
  Payload ID: 17730
  Gene Name: threonine synthase-like 2
  ENST ID: ENST00000419759
  CDS Start-End: 198-577
gggacgcggactcgggagtgcgcacattcgcagcccgggcagccctgctgcgcaccgggcctcgcgccccgcgccccgcgccccgcgccccgcgccccgcaccgctttgctgaattggcctgggaatgctgcccctggaaggcattggacagaacagggacagtcctgttgcgtgaggggcatgggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtactt

SEQ ID NO: 191011 - DNA, 1616 bp, Homo sapiens
  Payload ID: 17730
  Gene Name: threonine synthase-like 2
  ENST ID: ENST00000449349
  CDS Start-End: 182-958
gggacgcggactcgggagtgcgcacattcgcagcccgggcagccctgctgcgcaccgggcctcgcgccccgcgccccgcgccccgcgccccgcgccccgcaccgctttgctgaattggcctgggaatgctgcccctggaaggcattggacagaacagggacagtcctgttgcgtgaggggcatggagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtg

SEQ ID NO: 191012 - DNA, 4314 bp, Homo sapiens
  Payload ID: 17731
  Gene Name: threonyl-tRNA synthetase
  Uniprot ID: P26639
  ENST ID: ENST00000265112
  CDS Start-End: 312-2483
ggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacgcccagcctaaaaagcaacatcttgtcagtgctataatctcaaatagcttgtttgcaaggtgtgatggttaatactaagtgtcaacttgattggattaaaggatgcctttattgtttctgggtgtgtctgtgagggtgttgccagagagattgacatttgagtcagtggcctgggagaggcagacacaccctctgtgtgcgtgggcaccatccagtcggctgccagtgcagctagaacaaagcgggtggaagaaagtgggattaagttggcttgctgagtcttctggctttcatctttctcctgtgctggatgattcctgcccttggacatcagactccaggttcttcagcttttggactcttggacttatacccgtggtttgccaggggccttctggcctttggccattgactggagatggcactgtcggcttccctgcttttgaggcttggactcggactgaaccactactggcttccttgctccttagcttgcagacagcctatcgtgggacttcaccgtgtgcttgtgtgagtcaattcttactaaatttcctttcatatatacatatatcctattctgtctctctggagaaccctgactaatacacaagggtcacttcaaagagaagctaatttgcatagattaattttcactttaataaaggagctaagatctttaatcata

SEQ ID NO: 191013 - DNA, 2523 bp, Homo sapiens
  Payload ID: 17731
  Gene Name: threonyl-tRNA synthetase
  Uniprot ID: P26639
  ENST ID: ENST00000455217
  CDS Start-End: 123-2393
gattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcacacagcttcctgcaaaaacctctcttcacttgcatctctgcttgcatctgtggccattccctcatctggaatgccatggcctcctcttttcttccttcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacct

SEQ ID NO: 191014 - DNA, 2475 bp, Homo sapiens
  Payload ID: 17731
  Gene Name: threonyl-tRNA synthetase
  ENST ID: ENST00000507716
  CDS Start-End: 111-506
tggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgt

SEQ ID NO: 191015 - DNA, 466 bp, Homo sapiens
  Payload ID: 17731
  Gene Name: threonyl-tRNA synthetase
  ENST ID: ENST00000514259
  CDS Start-End: 80-466
gcattggggacttgactctggaaagcgtccagaccaaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctg

SEQ ID NO: 191016 - DNA, 608 bp, Homo sapiens
  Payload ID: 17731
  Gene Name: threonyl-tRNA synthetase
  ENST ID: ENST00000505012
  CDS Start-End: 93-449
gtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatg

SEQ ID NO: 191017 - DNA, 755 bp, Homo sapiens
  Payload ID: 17731
  Gene Name: threonyl-tRNA synthetase
  ENST ID: ENST00000506040
  CDS Start-End: 605-755
acagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaagattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaatta

SEQ ID NO: 191018 - DNA, 2534 bp, Homo sapiens
  Payload ID: 17731
  Gene Name: threonyl-tRNA synthetase
  Uniprot ID: P26639
  ENST ID: ENST00000502553
  CDS Start-End: 138-2309
atgattgttccacataaagtcagaagggaggaaaggcgcacgcgcattggggacttgactctggaaagcgtccagaccaaggtcagcggagagtaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattc

SEQ ID NO: 191019 - DNA, 656 bp, Homo sapiens
  Payload ID: 17731
  Gene Name: threonyl-tRNA synthetase
  ENST ID: ENST00000513066
  CDS Start-End: 92-292
tcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaaga

SEQ ID NO: 191020 - DNA, 2170 bp, Homo sapiens
  Payload ID: 17731
  Gene Name: threonyl-tRNA synthetase
  ENST ID: ENST00000509731
  CDS Start-End: 95-262
aagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagagactgacacagagggtatctgctgaatgaatgttgaagagattttgacacgaaattctaattgggacattgcaagtggctatgatgataaactgcagttaagatacagagggtggtgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatct

SEQ ID NO: 191021 - DNA, 2481 bp, Homo sapiens
  Payload ID: 17731
  Gene Name: threonyl-tRNA synthetase
  ENST ID: ENST00000508361
  CDS Start-End: 124-294
cgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattc

SEQ ID NO: 191022 - DNA, 171 bp, Homo sapiens
  Payload ID: 17731
  Gene Name: threonyl-tRNA synthetase
  ENST ID: ENST00000627006
  CDS Start-End: 1-171
atgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagtcaaggcctggccgacaacaccgttattgctaa

SEQ ID NO: 191023 - DNA, 201 bp, Homo sapiens
  Payload ID: 17731
  Gene Name: threonyl-tRNA synthetase
  ENST ID: ENST00000626210
  CDS Start-End: 1-201
atgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagggcaacttgcaggttttattcatctctgcaatcacagagactgacacagagggtatctgctga

SEQ ID NO: 191024 - DNA, 2106 bp, Homo sapiens
  Payload ID: 17732
  Gene Name: threonyl-tRNA synthetase 2, mitochondrial (putative)
  ENST ID: ENST00000369051
  CDS Start-End: 17-424
actggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggtccaagtacagaatatggcttttaccatgatttcttcctgggaaaggagaggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaact

SEQ ID NO: 191025 - DNA, 1998 bp, Homo sapiens
  Payload ID: 17732
  Gene Name: threonyl-tRNA synthetase 2, mitochondrial (putative)
  Uniprot ID: Q9BW92
  ENST ID: ENST00000369054
  CDS Start-End: 38-1804
aatctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgagg

SEQ ID NO: 191026 - DNA, 2729 bp, Homo sapiens
  Payload ID: 17732
  Gene Name: threonyl-tRNA synthetase 2, mitochondrial (putative)
  Uniprot ID: Q9BW92
  ENST ID: ENST00000369064
  CDS Start-End: 35-2191
ctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaactggaa

SEQ ID NO: 191027 - DNA, 2188 bp, Homo sapiens
  Payload ID: 17732
  Gene Name: threonyl-tRNA synthetase 2, mitochondrial (putative)
  ENST ID: ENST00000438568
  CDS Start-End: 312-1643
tttgttggaccagaagccaatgaagaattacgtggaggagaagcggcgataatctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagaggtccaagtacagaatatggcttttaccatgatttcttcctgggaaaggagaggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtagaggttgcagtgagctgagattgcgccactgcacccccctaggcgacagagcgagactctgtctctaaataaataaataaataaataaatacaaactggaagctgctg

SEQ ID NO: 191028 - DNA, 1855 bp, Homo sapiens
  Payload ID: 17732
  Gene Name: threonyl-tRNA synthetase 2, mitochondrial (putative)
  ENST ID: ENST00000467982
  CDS Start-End: 1-432
acccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcaggcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacat

SEQ ID NO: 191029 - DNA, 2162 bp, Homo sapiens
  Payload ID: 17732
  Gene Name: threonyl-tRNA synthetase 2, mitochondrial (putative)
  ENST ID: ENST00000606933
  CDS Start-End: 32-1942
tttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaa

SEQ ID NO: 191030 - DNA, 3610 bp, Homo sapiens
  Payload ID: 17733
  Gene Name: threonyl-tRNA synthetase-like 2
  Uniprot ID: A2RTX5
  ENST ID: ENST00000335968
  CDS Start-End: 218-2626
ctgcagggtatctggcctaggccccgcccctccccgcccagcgccccgcccctgcaacgtgtaggcctcggctccaacgaggccccatggctccgtccccgccccatcgccccgcccctcccgggagccctgtcttctgccgtgcgctgagtgtccgcgtcgccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgtactggcactccagtgctcacattcttggggaggccatggagctttactatggaggccacctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactgctaaatattggattactgacaaaggaattcagttttgtggaatctggtgtttgcactataggttaagagttgccatttaaatgtttcttattcataattaggttttgttccgctttagaaaaaaataaattcccaaatgaattgcatcagtgtttccagcgtttcagctgtgggcttctaccaccactaagccgctcacctagagttgttacttttttgatgggatgacattccatggatttatgtactgaaatggatttcagattttaaagagaggaatgctctacgtgctcagaactgaattaaaatggcattatgtcaatagagaattcagctaccaaacaagaagtattgtttattttgcgatatgctgtgaaattcaaaagaaatgtaagaaataatctcttttcaatatactgatcatttagttaacttcctgagggatgtgaacagtgaaacagttggcaaacaaaacaatatatatcag

SEQ ID NO: 191031 - DNA, 2774 bp, Homo sapiens
  Payload ID: 17733
  Gene Name: threonyl-tRNA synthetase-like 2
  ENST ID: ENST00000539112
  CDS Start-End: 24-2324
gtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgtactggcactccagtgctcacattcttggggaggccatggagctttactatggaggccacctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggaccggtttcttccttctgtgtggcaagaagcatggctgtagattcctgcatcatctcacaatatgggtcactagagagaacaaactttttacccacattccagaaagttctggctggctcgcatgggtctggtgtccactccttggctcatcagtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacggggga

SEQ ID NO: 191032 - DNA, 1916 bp, Homo sapiens
  Payload ID: 17733
  Gene Name: threonyl-tRNA synthetase-like 2
  ENST ID: ENST00000558533
  CDS Start-End: 1-447
gaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgaatgcaagacagatgtggctgatgaacaggagcagggcctgattgtgagggtcaccaaactgtaaaggcacttaaatgcacaaacccagtgatctcttattctaaggaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaa

SEQ ID NO: 191033 - DNA, 2356 bp, Homo sapiens
  Payload ID: 17733
  Gene Name: threonyl-tRNA synthetase-like 2
  ENST ID: ENST00000615656
  CDS Start-End: 56-2356
ccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgtactggcactccagtgctcacattcttggggaggccatggagctttactatggaggccacctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggaccggtttcttccttctgtgtggcaagaagcatggctgtag

SEQ ID NO: 191034 - DNA, 4109 bp, Homo sapiens
  Payload ID: 17734
  Gene Name: thrombomodulin
  Uniprot ID: P07204
  ENST ID: ENST00000377103
  CDS Start-End: 238-1965
ccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtggtggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatccca

SEQ ID NO: 191035 - DNA, 1855 bp, Homo sapiens
  Payload ID: 17735
  Gene Name: thrombopoietin
  Uniprot ID: P40225
  ENST ID: ENST00000204615
  CDS Start-End: 216-1277
tcttcctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaa

SEQ ID NO: 191036 - DNA, 1505 bp, Homo sapiens
  Payload ID: 17735
  Gene Name: thrombopoietin
  Uniprot ID: P40225
  ENST ID: ENST00000445696
  CDS Start-End: 212-1261
cctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgc

SEQ ID NO: 191037 - DNA, 1132 bp, Homo sapiens
  Payload ID: 17735
  Gene Name: thrombopoietin
  ENST ID: ENST00000421442
  CDS Start-End: 1-861
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggatcccaatgccatcttcctgagcttccaacacctgctccgaggaaaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctat

SEQ ID NO: 191038 - DNA, 7775 bp, Homo sapiens
  Payload ID: 17736
  Gene Name: thrombospondin 1
  Uniprot ID: P07996
  ENST ID: ENST00000260356
  CDS Start-End: 166-3678
agctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatctaaatcagggtgactttttaaaaaaaatccggaagctttttgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataatttt

SEQ ID NO: 191039 - DNA, 582 bp, Homo sapiens
  Payload ID: 17736
  Gene Name: thrombospondin 1
  ENST ID: ENST00000397591
  CDS Start-End: 301-582
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctg

SEQ ID NO: 191040 - DNA, 5811 bp, Homo sapiens
  Payload ID: 17737
  Gene Name: thrombospondin 2
  Uniprot ID: P35442
  ENST ID: ENST00000366787
  CDS Start-End: 251-3769
aggaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctatacatga

SEQ ID NO: 191041 - DNA, 437 bp, Homo sapiens
  Payload ID: 17737
  Gene Name: thrombospondin 2
  ENST ID: ENST00000435791
  CDS Start-End: 187-437
acattctgctccggtaacccatgcctgtggctcgctgggctaagtcagcccctggtgaagtttcatttgccgaattcatctctcatgacaacccgatgaggtgggcattttacatgacgctacgtttcattctacggatgaggaaactgagacagagaagttaagagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggctt

SEQ ID NO: 191042 - DNA, 5280 bp, Homo sapiens
  Payload ID: 17737
  Gene Name: thrombospondin 2
  Uniprot ID: P35442
  ENST ID: ENST00000617924
  CDS Start-End: 132-3650
gagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttc

SEQ ID NO: 191043 - DNA, 3145 bp, Homo sapiens
  Payload ID: 17738
  Gene Name: thrombospondin 3
  Uniprot ID: P49746
  ENST ID: ENST00000368378
  CDS Start-End: 22-2892
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaa

SEQ ID NO: 191044 - DNA, 2727 bp, Homo sapiens
  Payload ID: 17738
  Gene Name: thrombospondin 3
  Uniprot ID: P49746
  ENST ID: ENST00000457183
  CDS Start-End: 42-2552
cagctgcctgcctgccaggggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaag

SEQ ID NO: 191045 - DNA, 1833 bp, Homo sapiens
  Payload ID: 17738
  Gene Name: thrombospondin 3
  ENST ID: ENST00000428962
  CDS Start-End: 24-1226
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtgaccaatgcactgcactccattctaggtgaaggaaatgtccctgatccgaaacaccattatggagtgtcaggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagaccttcacctcacctggctgactgccaggggtctgattgtatggagagcaggctccagagactcccaggcagaagcgaagggaaggacaaggagtacctttaaatcctttatttggtacctgttcttctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtga

SEQ ID NO: 191046 - DNA, 2928 bp, Homo sapiens
  Payload ID: 17738
  Gene Name: thrombospondin 3
  ENST ID: ENST00000541990
  CDS Start-End: 1421-2878
gggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaaggtgactgtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacagataaggccataccagtgtcctctgctgtatctgaggagacccaccataggtctggttccacccaaagtctgccccttcaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttg

SEQ ID NO: 191047 - DNA, 3200 bp, Homo sapiens
  Payload ID: 17738
  Gene Name: thrombospondin 3
  ENST ID: ENST00000541576
  CDS Start-End: 106-2949
ccccctccaattctgtccctccgccccccggctcctgctctctccgcctagccttttcccctcccagctgcctgcctgccaggggtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttct

SEQ ID NO: 191048 - DNA, 3222 bp, Homo sapiens
  Payload ID: 17739
  Gene Name: thrombospondin 4
  Uniprot ID: P35443
  ENST ID: ENST00000350881
  CDS Start-End: 191-3076
agcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaa

SEQ ID NO: 191049 - DNA, 3094 bp, Homo sapiens
  Payload ID: 17739
  Gene Name: thrombospondin 4
  ENST ID: ENST00000511733
  CDS Start-End: 341-2953
ggagcgatgtatgcccagagtctgctcttgacatccctgagaaagacgcagaattactctacttgccctgccacctgcattttctgctctgactttgcttgaacgacaaaaagaaagtttatttcaaggattggcttgatgtcttaatttctgagtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcattttt

SEQ ID NO: 191050 - DNA, 2962 bp, Homo sapiens
  Payload ID: 17740
  Gene Name: thrombospondin, type I, domain containing 1
  Uniprot ID: Q9NS62
  ENST ID: ENST00000258613
  CDS Start-End: 180-2738
cgggatgcttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacatcgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagaaacttggggactgtggcagccatggagccagtgtagtgccacatgtggggatggtgtcagagagcgtcgccgagtgtgtctcacttccttcccctccagtcctgtctgccctggaatgtccttggaggcctccctgtgttccctggaggagtgtgctgctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgata

SEQ ID NO: 191051 - DNA, 3189 bp, Homo sapiens
  Payload ID: 17740
  Gene Name: thrombospondin, type I, domain containing 1
  Uniprot ID: Q9NS62
  ENST ID: ENST00000349258
  CDS Start-End: 546-2945
actagagtagaagtgattgaatgtgaagtgtcaggagattgctcgctcgtccttcgttaaacccctggtccggctgtgtgctgtggatgcgggtgtgtgttgaggggacctgcgtctgccggggccgcaccccctcccgcaggaccttggctggccgcgcgtttcctgcctgtttcctgtccagcagctggcgagctggggaccggcaggaaaggatgcgctgcccagaaggggcgggaaccgaccacgcccggtcccgtgtgccccccgccctcccggcgcccgccctccccacgccgtcgggggcgggccccgcggggctgtgggagccgaacgccgcggggtcagggcgtgcagtctgggacgcgggatgcttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacctgggattttgtcaatcagaatgaaaccaatgttgaaagacttttcaaatctattgttggtggtactctgtgactatgttcttggagaagctgaatatcttctcttgagagagccaggccatgtagcactaagcaacgacacagtgtatgtggatttccagtattttgatggtgctaatgggacactgaggaatgtatctgtcctgctgttggaggccaacaccaatcagactgtaactaccaagtacctcctgaccaaccagtcccagggaacactaaagtttgagtgcttctatttcaaggaggctggtgactactggttcacaatgactccagaagcaacagacaacagcactccattcccctggtgggagaaaagtgcctttctgaaggtggaatggcctgtctttcacgttgacttgaataggagtgccaaggcagcagaaggcaccttccaagtgggcctatttaccagtcaaccactgtgcccgtttcctgtggacaagcccaacatcgtagtggatgtcatcttcaccaacagtcttcctgaggcaagaagaaattcaagacagccgctggaaataagaaccagcaaaaggacagaacttgctcaaggtcagtgggttgagtttggctgtgcacccttggggccagaagcctatgtcaccgtggtgctgaagctgcttgggcgagactcagtcattacctccacaggacccattgacctggcccagaaatttggatacaaactggtgatggtgccagaactcacatgtgagtccggggtagaggtgacagtgctgcctccaccatgcaccttcgtccaaggagtggtcactgtcttcaaggaggcccccagataccctgggaagaggaccattcacttggctgaaaacagcctgcccctgggagagaggaggacaatttttaactgtactttgtttgacatggggaagaataagtactgctttgactttggcatttcaagcagaagccatttttctgcaaaggaggagtgcatgctaattcagagaaatacagctttccagccatccagcccatctcctcttcagccccagggtccagtgaagtccaacaacatcgtgactgtcactggtatatccttgtgcttgttcatcatcattgccactgtgctcatcacgctgtggaggaggttcggccggccagccaagtgcagcacacctgctcgacacaactccatccactcccccagcttccggaagaactcggacgaggagaatatctgcgagctgagcgagcagcgcgggagcttctcggatgggggagacgggcccacggggagtccaggggacacaggcatccctctgacctacaggcggagcgggccggtacctcccgaggatgatgcctctggcagcgagagcttccagtccaacgcccagaagataatcccacctctgttcagctaccgccttgcccagcagcagttaaaggagatgaaaaagaaaggtctgacggaaactaccaaagtgtatcacgtgtctcagagtcccctgacagacactgccattgatgcggcccccagcgctcccttagatttggaaagcccggaagaagctgcagcaaacaagttccggatcaaatccccatttccggagcagcccgcggtcagtgccggggaaaggcctccctccaggctggatctaaatgtgactcaggccagttgtgccataagccccagccagactctgatccgcaagtcacaggcaaggcacgtgggcagcagagggggcccgtccgaaaggagccatgccaggaacgcccatttcaggaggacagcgagtttccatgaagccaggcaggcccggccgttccgagagaggagcatgtccactctgactccacggcaggcccctgcctacagctctaggacgcggacctgcgagcaggcagaggacagatttaggcctcagagtcgaggtgcccacctgtttcctgaaaaactggagcatttccaagaggcaagtggaacccgtggtccattaaaccctctccctaaatcctacactttggggcagcccttgaggaaaccagaccttggggatcaccaggcaggattagtggccggaattgagagaacagagccccacagagctcgtcggggaccgtcccccagtcacaagagtgtctcaaggaagcagtcttctcccatatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagctttacacagctggggtctgctactcgcgttttgtagacttttgtgtaactatttgtaccgtaggacagaatgtgaggaggaagtaacacacagaggaggatgtgtgtgtatgcatgtgtttgaattcacaaggaagaaattatttatcttgagctttttcctttgttattcaatttctattgatttattagtaataacaatgataataaaatgtaaatgagcaaa

SEQ ID NO: 191052 - DNA, 3133 bp, Homo sapiens
  Payload ID: 17741
  Gene Name: thrombospondin, type I, domain containing 4
  Uniprot ID: Q6ZMP0
  ENST ID: ENST00000261862
  CDS Start-End: 129-788
gccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgc

SEQ ID NO: 191053 - DNA, 9200 bp, Homo sapiens
  Payload ID: 17741
  Gene Name: thrombospondin, type I, domain containing 4
  Uniprot ID: Q6ZMP0
  ENST ID: ENST00000355327
  CDS Start-End: 135-3191
atcagaccaacgtgaattgaatcacagcagttcagaaagaggaaactggattcaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagccgccagggccccacggtgctgcgaggcagccggcacccacagccccagggcctcgaagtcactggggacagaaggagcaggacccgtggtaccattggccctggcaagtatggctatggtaaggccccatatatcttaccactgcagacagacactgcacacacgccacagaggctccggagacagaagctctcatcccgccattccaggtcccagggagcatcttctgctaggcatggctacagttcaccagcccaccaggtcccccaacatgggcctttgtaccaaagtgacagtggccctcgctctggactgcaggctgcggaggcccccatctaccagctacctttgacccatgatcaaggctaccctgcagcttcaagtctctttcacagcccagaaacaagcaacaaccacggtgtggggacccatggggcaactcagagcttctctcagcctgcccgatctacagcaatctcatgcatcggggcctatcggcagtacaagctgtgcaacaccaacgtatgtccagaaagcagtagaagtatccgggaggtacagtgtgcatcctacaacaacaagccattcatgggccggttttatgagtgggaaccatttgcagaagtaaaaggcaatcgcaaatgtgagttgaactgccaggcaatgggctaccgcttctatgtacggcaagctgagaaagtcatcgatggcaccccctgtgaccagaacggcacggccatctgtgtgtctgggcagtgcaagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttacccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccctctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatc

SEQ ID NO: 191054 - DNA, 3403 bp, Homo sapiens
  Payload ID: 17741
  Gene Name: thrombospondin, type I, domain containing 4
  Uniprot ID: Q6ZMP0
  ENST ID: ENST00000357769
  CDS Start-End: 175-2151
agaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtc

SEQ ID NO: 191055 - DNA, 416 bp, Homo sapiens
  Payload ID: 17741
  Gene Name: thrombospondin, type I, domain containing 4
  ENST ID: ENST00000620694
  CDS Start-End: 114-416
cggccgccggtcgctccgggacgcggaccgccaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcg

SEQ ID NO: 191056 - DNA, 10663 bp, Homo sapiens
  Payload ID: 17742
  Gene Name: thrombospondin, type I, domain containing 7A
  Uniprot ID: Q9UPZ6
  ENST ID: ENST00000423059
  CDS Start-End: 253-5226
attctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaaagattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcaggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaa

SEQ ID NO: 191057 - DNA, 10583 bp, Homo sapiens
  Payload ID: 17742
  Gene Name: thrombospondin, type I, domain containing 7A
  ENST ID: ENST00000617773
  CDS Start-End: 253-5226
attctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcagtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccagtttcaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaaagattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcaggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattct

SEQ ID NO: 191058 - DNA, 5939 bp, Homo sapiens
  Payload ID: 17743
  Gene Name: thrombospondin, type I, domain containing 7B
  Uniprot ID: Q9C0I4
  ENST ID: ENST00000272643
  CDS Start-End: 1-4827
atgtttccaaagagcaacctaacagtcacttgctgggtatggaggagcatgaggaagctctttctattgctttctctcttgctgtcccatgcagctcatttggaaggcaaaaaggataatcagttcatctggaaaccaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcagggacaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 191059 - DNA, 6111 bp, Homo sapiens
  Payload ID: 17743
  Gene Name: thrombospondin, type I, domain containing 7B
  ENST ID: ENST00000409968
  CDS Start-End: 179-4999
agtgctgaggagccagagtcgccgccgggttgccagacgctggaatgggtggtcttccgacacacaccaccatctttcttgcgctcgggaagctcggggctcagcggctcccagaggttacggcggcggctctggcgagacgggaataggcaagtcaagaggctgaaaaatctgaagcatgtttccaaagagcaacctaacagtcacttgctgggtatggaggagcatgaggaagctctttctattgctttctctcttgctgtcccatgcagctcatttggaaggcaaaaaggataatcagttcatctggaaaccaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 191060 - DNA, 5846 bp, Homo sapiens
  Payload ID: 17743
  Gene Name: thrombospondin, type I, domain containing 7B
  ENST ID: ENST00000413152
  CDS Start-End: 1-4734
atgcataacacagcagatgaggtggttttgtatcacaaattagcaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaagcctttgccttcaagattccttcccattgactgttcagtcctgcatcatgcccaaagactgtgaaacctcccagtggtcctcctggagcccctgctccaagacatgccgttcagggagtctcttgccaggatttaggagcaggagccggaacgtgaagcacatggctattggaggtggaaaggagtgtcctgaacttcttgagaaagaggcctgcattgttgaaggagaacttctgcagcaatgtcccaggtattcctggagaacttctgaatggaaagaatgccaagtctctctcctcctcgagcagcaggatccccactggcatgtgacgggacccgtgtgtggcggtgggatccagacccgggaggtgtactgtgcccagagcgtaccagcagctgccgcactgagggccaaggaagtctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaaggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggagaagatgtatcagggagtctttgcccagttccccctcctcctgagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagatgtccagattctactcgacctgaaactgtgcgcccctgttttctcccatgcaaaaaagactgtattgtgactgctttcagtgagtggacaccctgcccaaggatgtgccaagcaggaaatgccacagtaaaacagtctcgatacagaatcatcatccaagaagcagccaatggaggccaggaatgcccagataccttatatgaggagagagagtgtgaagatgtttccttgtgtcctgtatatcggtggaagccacagaaatggagcccttgcatcttagtgccagagtctgtctggcagggaataacgggcagcagtgaagcctgtggaaaggggttacaaacaagagctgtctcatgcatctctgatgacaaccggtcagcagaaatgatggaatgcctcaagcagacaaacggcatgcctctccttgtgcaagaatgcacagtcccatgtcgagaagactgcaccttcactgcttggtccaagtttacgccctgctccacgaactgtgaagccacaaaaagtaggcggcgacagctcacagggaaaagcagaaagaaggagaaatgccaggattctgacctttaccctctagtggagacagaactatgtccttgtgatgaatttatatcccaaccttatggaaactggtcagattgcattcttccagaaggcagaagggagcctcaccgaggactgcgggtacaagcagacagcaaagaatgtggagaaggcctgcgctttcgagcagtagcctgttctgataaaaatggaagacctgttgacccctccttctgcagcagctctggttacattcaagaaaaatgtgtcattccctgcccatttgattgcaagttaagcgattggtctagttgggggtcttgcagttcatcttgtggaattggagtgagaattcgatccaaatggctaaaagaaaaaccttacaatggaggacgaccatgtcccaaactggatctcaagaatcaggctcaggtacatgaggcagtcccatgttacagtgagtgcaatcagtattcctgggttgtagaacactggtcttcatgcaaaatcaacaatgagctgaggtccctgcgctgtggaggaggaacacaatctaggaaaatcagatgtgtgaatactgcggatggtgaaggtggagcagtggatagcaacctgtgcaaccaggatgaaattcccccagaaacccagtcctgttctcttatgtgtcccaatgagtgtgtcatgtctgagtggggactttggagcaaatgcccacagtcatgcgatccccacacaatgcagagaagaactcgccacctgctaagaccatcactgaactcaaggacttgtgctgaagactcacaggtgcagccttgcctcctgaatgaaaattgcttccagttccagtacaatctaacagagtggagcacatgccagctgagtgaaaacgcaccctgtggtcaaggcgtcaggacccgcctgctaagctgtgtgtgcagtgatggcaagccagtcagcatggaccaatgtgagcagcataatttggagaagccccagagaatgagcattccctgcttggtggaatgcgtggtcaactgtcagctctcagggtggacggcttggacagagtgttcacagacctgtggccatggaggtcgaatgagccggactcgatttatcattatgccaacccaaggagaaggacggccatgccccacagagcttacccaggagaaaacctgcccagtgaccccctgctacagctgggtccttggcaactggtctgcatgtaaattggagggtggagactgtggggaaggagttcagatccgcagcctttcctgcatggtccacagtggttcaatatctcatgcagctggacgtgtcgaggatgcactgtgtggagaaatgccctttcaggacagcatcctgaagcagctgtgttctgtgccttgcccaggagactgccatttaacagaatggtcagagtggagcacatgtgaattaacctgcattgatggaagaagctttgagactgtgggccgccagtctagatcaaggacttttataattcagtcttttgagaaccaagacagctgcccccaacaggttctagaaacacgcccttgtacaggaggcaaatgttatcactacacatggaaagcaagtctttggaacaataacgaacgaactgtatggtgccagcgttcagatggcgttaatgtcacaggaggctgctcccctcaggcccgtcctgctgccattcggcagtgcattccagcctgcagaaaacctttctcctactgtacacagggtggagtctgtggttgtgagaagggctatacagagataatgaaatcaaatggtttcctggattactgcatgaaagtaccaggctcagaggataaaaaagctgatgtgaaaaacctttctgggaaaaacagacctgtgaattcaaaaatacatgatatttttaaaggatggtctcttcaaccacttgatccagatggccgagtaaaaatttgggtttatggcgtttcaggtggcgcttttctcatcatgattttcctaatatttacttcctaccttgtttgcaagaagccaaaaccacatcaaagcacacctccccaacagaagcctctgaccttagcctacgatggagacttagacatgtaatctgaaaaagaaatccaaatgtagacatcaactgccttaaccgctttctcttttgtagctctcagacttctcagttttttgaggaatctcaagatgtgatatattgggcagaatacaaatattgcaaaagtaatattgcctcaacttcatttggacatggagtcaaggattattaggtctgccattttgttttcaagttgtttgtgggtgtgttttatttttttggttttcccaagggacctgaaaacccttctcttcctgtttggaactgggaggaagaaaacatgatggaattcccacagacttgagtaaacttgatcttcagcagcataatgacaatccagaggaaaatacagtcaaggcatttactctaaatgacgagtctgacactgcattgttacgcactatattagtgcaaagtctttattcttcccatacttcaacactgagttttctagagtttactttggtttaaagactttcaaattggattgcctatttttcatgaacacagagagaatggattaccatttcagaaattctctgagtttttaacctttaaatattgtattttgttttgtagccaggggatgatggcgcttcatgggttgcagctactgaaaatagcagcgtgtgtgtaattgctggactagatgaaagctaggtcatttctgaagggaatgtgtactgaatgttagagtgtacaaatgaaatatgtggttaaattggagaatgaggtagattatttgattactaaaactgtattttaacaaaaacttatccatgtagatatagcattaaccacacacagttgtaattcagtttaatgatgacaaactctgcttttgtaatttcaattttcttatctgaatatttataaattcttctttcaaatttaattatctgacctcatttaatatacatcaaacaccgatcctgtttgtacaaagtcttgcttttataaggtttcaataatatctaaaacaacacattaaaaagctgagaccattttatgaagataattgtttgtaatcataggtgttgaaagtaaaaaggtgccatcttgtggtattgacttgtatttataacaaataaactgctcaagagactgc

SEQ ID NO: 191061 - DNA, 532 bp, Homo sapiens
  Payload ID: 17743
  Gene Name: thrombospondin, type I, domain containing 7B
  ENST ID: ENST00000472720
  CDS Start-End: 179-331
agtgctgaggagccagagtcgccgccgggttgccagacgctggaatgggtggtcttccgacacacaccaccatctttcttgcgctcgggaagctcggggctcagcggctcccagaggttacggcggcggctctggcgagacgggaataggcaagtcaagaggctgaaaaatctgaagcatgtttccaaagagcaacctaacagtcacttgctgggtatggaggagcatgaggaagctctttctattgctttctctcttgctgtcccatgcagctcatttggaaggcaaaaaggataatcagttcatctggaaaccaggacttgccaagtagaagaaagcacttattggagagggggagtagagtcaagcaaataaacctgagatttttaggatcatttttataagtcttgaattcgttgatgatgttaacaaaaaagtccgtggggaaggtgtacaggagactgtggtcccggaggagtccagagtcgggcagtgtggtgttttcatgttgacgggtggacaagtcacctgt

SEQ ID NO: 191062 - DNA, 3967 bp, Homo sapiens
  Payload ID: 17744
  Gene Name: thrombospondin-type laminin G domain and EAR repeats
  Uniprot ID: Q8WU66
  ENST ID: ENST00000323084
  CDS Start-End: 67-2076
tgaggagcagccacttccctgcaggctgagcggagccctggatggagcttggcacccaagcccctcatgtctgccctgctgagtctgtgttttgtgctgcccctggcggcccccggccacggcacgcagggttgggagccctgcacagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctgaggccgcggctgcccggcagcaactggggtggccaggtggggcgggaccccagcacctcccccaactgaccctggacgtccaggtgggcccagcctagggcatcccgggcctgggcatcaggcagggtgcaggtggggccatctgcggccctggttcgggcagggacatccatccacctctgagtccttctgagccacagccccagtgacggtctggtcttgcaggcagaggcccagagcccctgccagtgctcgcccatctgagtgtcaagcggggatttcgctgtcaaggaaccgtttctatacatttttacctcaaacaacaggacctcggttcatgtccctgcggctggcctctcgccagccactcctgcagtgtgcgtccggccgcctgagcaggtgtggtgccgtcccgccattgccgccacctatttattgtgttttatctgaacggaagtgtatttatactgctctttacaaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaacttctgggcccgggattttttccctattcagcagcattttaatcacatgtcctccagctgactgggactcaggctgcgtgcctccgtctgcctgtgtgctggctgtcctagctccctggtaacagcatcctctgctggctctcctgtggtcatcttgtctctgcagctgggagagctgcttgtctgtccgtcacaggcagtgaggatgagagggggtgatgggcgcaaggccccaggggtcctccctcttaacccatgtaggtgccagagaaaccacccccactccatgagaagaggctcagacagcaggctccggggccacgcagcccagaccacacctgccacggtcttccaggaacggtgctcctgcttctgcaacacaaatcggaacaggagcgatcctcagagagtttacaatgtgctttttccgccaatcagaactgtggacaaaacttcctatttcctacaccgcagctgtctgttcaccttcagctcagagagcactcctgacctttcgtaatgaaatggaagcctccccttgtctggcaaataataaactcagtgtctacttttgccggctttgggaccttcgtgtttttccggggctcaggtctcactccagccatcgctgtggccagtggagagccactcccctctgggggcagtcgccgagagcctccttcccctccgtccagccagcaaggctttcccaagcgtcctgggcaggagggttgggccctgctttccaccaagtcactcagaaggtcccaatcacacatgattggcctcattgggtcagcacctgtgaaaggaagattaaaaactcgacaccccaattcactcaaccaagaagaaaaaagctgaaagctgagtcctgcaggaagctgcctttccctttgccctaagcagacagctgcagatgagagggtcagcatctccactagtggctgctctgtgtgccccttatctcatggaaagtgccaatttactgagcacgagataaacaggtaactgactgttcccacctgctccttttctcctgcagcatggagcaatcagtcatgtgaccacaccctcctccctctgccccctccagccggcttttccccttgactgaagccttcaacatcatcttgggagagaggcacagacctgtctcctgggtgcatccttagccttggcaaaataaacttctccattgatcgag

SEQ ID NO: 191063 - DNA, 2114 bp, Homo sapiens
  Payload ID: 17744
  Gene Name: thrombospondin-type laminin G domain and EAR repeats
  ENST ID: ENST00000397916
  CDS Start-End: 160-1752
aggaaccaggaaggcagacgcggctgctgtagctcagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtggaggcaggagggggcttcatgcccgtcgtgcggagggatagccgaggccccagagggacaggtgcgaggtgcaggcttcgagtgcccgctgcctgccagtgccagctgccaccagacatgattacttccttcccccgatgttgcatcctccccgacaacaaacaccaggacacggagactggcctgttgagacagatgtgagatccagggaacatggagggtgggtctgtatgtacgagaaagtgatggttccagaccgacacgctccgtggagccacaggaggttgcgtgggcaccacattttggacagtgggcactgagaatccacaaccatcctgaccagtgtggggcgtcctctggggtggaattccggtctgtgaataaacctgcaatcgaatccgta

SEQ ID NO: 191064 - DNA, 3524 bp, Homo sapiens
  Payload ID: 17744
  Gene Name: thrombospondin-type laminin G domain and EAR repeats
  ENST ID: ENST00000613245
  CDS Start-End: 67-1635
tgaggagcagccacttccctgcaggctgagcggagccctggatggagcttggcacccaagcccctcatgtctgccctgctgagtctgtgttttgtgctgcccctggcggcccccggccacggcacgcagggttgggagccctgcacagacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctgaggccgcggctgcccggcagcaactggggtggccaggtggggcgggaccccagcacctcccccaactgaccctggacgtccaggtgggcccagcctagggcatcccgggcctgggcatcaggcagggtgcaggtggggccatctgcggccctggttcgggcagggacatccatccacctctgagtccttctgagccacagccccagtgacggtctggtcttgcaggcagaggcccagagcccctgccagtgctcgcccatctgagtgtcaagcggggatttcgctgtcaaggaaccgtttctatacatttttacctcaaacaacaggacctcggttcatgtccctgcggctggcctctcgccagccactcctgcagtgtgcgtccggccgcctgagcaggtgtggtgccgtcccgccattgccgccacctatttattgtgttttatctgaacggaagtgtatttatactgctctttacaaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaacttctgggcccgggattttttccctattcagcagcattttaatcacatgtcctccagctgactgggactcaggctgcgtgcctccgtctgcctgtgtgctggctgtcctagctccctggtaacagcatcctctgctggctctcctgtggtcatcttgtctctgcagctgggagagctgcttgtctgtccgtcacaggcagtgaggatgagagggggtgatgggcgcaaggccccaggggtcctccctcttaacccatgtaggtgccagagaaaccacccccactccatgagaagaggctcagacagcaggctccggggccacgcagcccagaccacacctgccacggtcttccaggaacggtgctcctgcttctgcaacacaaatcggaacaggagcgatcctcagagagtttacaatgtgctttttccgccaatcagaactgtggacaaaacttcctatttcctacaccgcagctgtctgttcaccttcagctcagagagcactcctgacctttcgtaatgaaatggaagcctccccttgtctggcaaataataaactcagtgtctacttttgccggctttgggaccttcgtgtttttccggggctcaggtctcactccagccatcgctgtggccagtggagagccactcccctctgggggcagtcgccgagagcctccttcccctccgtccagccagcaaggctttcccaagcgtcctgggcaggagggttgggccctgctttccaccaagtcactcagaaggtcccaatcacacatgattggcctcattgggtcagcacctgtgaaaggaagattaaaaactcgacaccccaattcactcaaccaagaagaaaaaagctgaaagctgagtcctgcaggaagctgcctttccctttgccctaagcagacagctgcagatgagagggtcagcatctccactagtggctgctctgtgtgccccttatctcatggaaagtgccaatttactgagcacgagataaacaggtaactgactgttcccacctgctccttttctcctgcagcatggagcaatcagtcatgtgaccacaccctcctccctctgccccctccagccggcttttccccttgactgaagccttcaacatcatcttgggagagaggcacagacctgtctcctgggtgcatccttagccttggcaaaataaacttctccattgatcg

SEQ ID NO: 191065 - DNA, 4027 bp, Homo sapiens
  Payload ID: 17744
  Gene Name: thrombospondin-type laminin G domain and EAR repeats
  ENST ID: ENST00000614657
  CDS Start-End: 333-2138
tgaggagcagccacttccctgcaggctgagcggagccctggatggagcttggcacccaagcccctcatgtctgccctgctgagtctgtgttttgtgctgcccctggcggcccccggccacggcacgcagggttgggagccctgcacagcatgctcatctttgaaagcgtgggctgaatgctgacctcccggacatcatgagtgttgttctacctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctgaggccgcggctgcccggcagcaactggggtggccaggtggggcgggaccccagcacctcccccaactgaccctggacgtccaggtgggcccagcctagggcatcccgggcctgggcatcaggcagggtgcaggtggggccatctgcggccctggttcgggcagggacatccatccacctctgagtccttctgagccacagccccagtgacggtctggtcttgcaggcagaggcccagagcccctgccagtgctcgcccatctgagtgtcaagcggggatttcgctgtcaaggaaccgtttctatacatttttacctcaaacaacaggacctcggttcatgtccctgcggctggcctctcgccagccactcctgcagtgtgcgtccggccgcctgagcaggtgtggtgccgtcccgccattgccgccacctatttattgtgttttatctgaacggaagtgtatttatactgctctttacaaaagcaccggtgctcctctctaggcagcgggtgggcacagcccctcaccacggacacggacagaggaccacctccccatacagagagaggcttccctcccagcctcagtttacccgtaaatgcactagcgcgaggtcagaaatcacaagcctgggcatggcctgggtcgcaccccctccccacggccccacccacagggacctcaacttctgggcccgggattttttccctattcagcagcattttaatcacatgtcctccagctgactgggactcaggctgcgtgcctccgtctgcctgtgtgctggctgtcctagctccctggtaacagcatcctctgctggctctcctgtggtcatcttgtctctgcagctgggagagctgcttgtctgtccgtcacaggcagtgaggatgagagggggtgatgggcgcaaggccccaggggtcctccctcttaacccatgtaggtgccagagaaaccacccccactccatgagaagaggctcagacagcaggctccggggccacgcagcccagaccacacctgccacggtcttccaggaacggtgctcctgcttctgcaacacaaatcggaacaggagcgatcctcagagagtttacaatgtgctttttccgccaatcagaactgtggacaaaacttcctatttcctacaccgcagctgtctgttcaccttcagctcagagagcactcctgacctttcgtaatgaaatggaagcctccccttgtctggcaaataataaactcagtgtctacttttgccggctttgggaccttcgtgtttttccggggctcaggtctcactccagccatcgctgtggccagtggagagccactcccctctgggggcagtcgccgagagcctccttcccctccgtccagccagcaaggctttcccaagcgtcctgggcaggagggttgggccctgctttccaccaagtcactcagaaggtcccaatcacacatgattggcctcattgggtcagcacctgtgaaaggaagattaaaaactcgacaccccaattcactcaaccaagaagaaaaaagctgaaagctgagtcctgcaggaagctgcctttccctttgccctaagcagacagctgcagatgagagggtcagcatctccactagtggctgctctgtgtgccccttatctcatggaaagtgccaatttactgagcacgagataaacaggtaactgactgttcccacctgctccttttctcctgcagcatggagcaatcagtcatgtgaccacaccctcctccctctgccccctccagccggcttttccccttgactgaagccttcaacatcatcttgggagagaggcacagacctgtctcctgggtgcatccttagccttggcaaaataaacttctccattgatcg

SEQ ID NO: 191066 - DNA, 2367 bp, Homo sapiens
  Payload ID: 17745
  Gene Name: thromboxane A synthase 1 (platelet)
  ENST ID: ENST00000263552
  CDS Start-End: 539-2143
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 191067 - DNA, 2185 bp, Homo sapiens
  Payload ID: 17745
  Gene Name: thromboxane A synthase 1 (platelet)
  Uniprot ID: P24557
  ENST ID: ENST00000336425
  CDS Start-End: 390-1991
aaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 191068 - DNA, 752 bp, Homo sapiens
  Payload ID: 17745
  Gene Name: thromboxane A synthase 1 (platelet)
  ENST ID: ENST00000438104
  CDS Start-End: 303-752
gtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgag

SEQ ID NO: 191069 - DNA, 2080 bp, Homo sapiens
  Payload ID: 17745
  Gene Name: thromboxane A synthase 1 (platelet)
  Uniprot ID: P24557
  ENST ID: ENST00000425687
  CDS Start-End: 490-1890
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggagctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattg

SEQ ID NO: 191070 - DNA, 2505 bp, Homo sapiens
  Payload ID: 17745
  Gene Name: thromboxane A synthase 1 (platelet)
  ENST ID: ENST00000416849
  CDS Start-End: 539-2281
gagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggctcacagaacatttcctgcctgttgctcacactctgttgtccacagcatacccgcaccctagatggctgactcttgtcttctgtctctttattttccatgtgtgagcctgtgcctgtggtttatctctggaggatgtgcctgagggaggagacatatactgcctggactgcctggctgatgtgagctagtttgtctggttgagttggatgtttaaatagaaggcagaacaacaacagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagcttggccttttaatcatgcaagagagaataaaaggtcacatgggtggccagcaggctccacaaagaattccacccacccgtttgtcgaagccgagtggtatctatgtgaatctccattatgccactctacctttctgtatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 191071 - DNA, 1435 bp, Homo sapiens
  Payload ID: 17745
  Gene Name: thromboxane A synthase 1 (platelet)
  ENST ID: ENST00000455353
  CDS Start-End: 138-593
gtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatgccccagagcatcatgcccaactccagacatcacgtggcctctagagggatgtggcctggagggaggcggctggcctgctacctccatcccttcaggatggccgaaggaattgcagaagtttaactgcttctctgctgcctctagattctctttcccaaacactgcattgctatctcctcgctcaaagtcccctggaagccgtctgtcaagaaactgattctgattattaaatgcagctgtagcttgttgctccatcagcctcagcaaggagtgctgattaaagaagttggagaagccaataagtcaaagtgcacggaccaccaagccacatcctggcaagcagtaaaggtactcccaggagcctgtcatagcacttgagactgtctgagcccctaagccatgagacggcacttgccaactggtgtctccatatttcctcccatgataccaggacatgtgaccctgagagctgacctagaagaggtcaatgatttggcctgctaggggcagacatactcaatgcacatgtccaagcaaggaggacacaataatattgccctcagctttgatcaatttatcctccaagccatttgtctgccgtttctaatttctttcaccatcccctcacccacccctccacgcagactaggtccagtgccccaaactccagagtagagttccaattttcgtcctcttccactcagcacaggattaagccttcaggactaagttcaagttccctagacgatatttaagggcccttgtgtcttagatccattgtgtgtgctccaccctgtctctcactgctccccaatacaaatcgtcactccagcctctccctgctcaccctcacctgctctggagagacctgacctctgccttgctcacgctgacactgcctcagaattgaaggcagtgtaacagtggggctcatattgattatgacgtgagcttgagcacatatc

SEQ ID NO: 191072 - DNA, 1901 bp, Homo sapiens
  Payload ID: 17745
  Gene Name: thromboxane A synthase 1 (platelet)
  ENST ID: ENST00000414508
  CDS Start-End: 236-1618
aaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatg

SEQ ID NO: 191073 - DNA, 1963 bp, Homo sapiens
  Payload ID: 17745
  Gene Name: thromboxane A synthase 1 (platelet)
  Uniprot ID: P24557
  ENST ID: ENST00000448866
  CDS Start-End: 168-1769
atagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaa

SEQ ID NO: 191074 - DNA, 2057 bp, Homo sapiens
  Payload ID: 17745
  Gene Name: thromboxane A synthase 1 (platelet)
  Uniprot ID: P24557
  ENST ID: ENST00000458722
  CDS Start-End: 138-1877
gtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagcttggccttttaatcatgcaagagagaataaaaggtcacatgggtggccagcaggctccacaaagaattccacccacccgtttgtcgaagccgagtggtatctatgtgaatctccattatgccactctacctttctgtatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggt

SEQ ID NO: 191075 - DNA, 1792 bp, Homo sapiens
  Payload ID: 17745
  Gene Name: thromboxane A synthase 1 (platelet)
  Uniprot ID: P24557
  ENST ID: ENST00000411653
  CDS Start-End: 128-1507
actccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatgaa

SEQ ID NO: 191076 - DNA, 565 bp, Homo sapiens
  Payload ID: 17745
  Gene Name: thromboxane A synthase 1 (platelet)
  ENST ID: ENST00000414041
  CDS Start-End: 90-332
ctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtggtctgtagtgcagtggcttgatcttggatcactgcaacctccaccttccaggttcaagcaattctcctgcctcagcctcctgagtagctggcactacaggtactatcttggtcgtcggatgtttattgttatttctgagccagacatgatcaagcaggtgttggttgagaacttcagtaactttaccaacagaatggcgtcgggtttggagttcaagtcggtagccgacagcgttctgttt

SEQ ID NO: 191077 - DNA, 1967 bp, Homo sapiens
  Payload ID: 17745
  Gene Name: thromboxane A synthase 1 (platelet)
  ENST ID: ENST00000422328
  CDS Start-End: 145-384
gcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtaagaaggaaactcaacgtttctattatgtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgcc

SEQ ID NO: 191078 - DNA, 2608 bp, Homo sapiens
  Payload ID: 17746
  Gene Name: thromboxane A2 receptor
  Uniprot ID: P21731
  ENST ID: ENST00000375190
  CDS Start-End: 395-1426
agcggcccccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggc

SEQ ID NO: 191079 - DNA, 1494 bp, Homo sapiens
  Payload ID: 17746
  Gene Name: thromboxane A2 receptor
  Uniprot ID: P21731
  ENST ID: ENST00000411851
  CDS Start-End: 215-1438
ccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggtttta

SEQ ID NO: 191080 - DNA, 1814 bp, Homo sapiens
  Payload ID: 17746
  Gene Name: thromboxane A2 receptor
  ENST ID: ENST00000589966
  CDS Start-End: 36-815
tggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatca

SEQ ID NO: 191081 - DNA, 4122 bp, Homo sapiens
  Payload ID: 17747
  Gene Name: THUMP domain containing 1
  Uniprot ID: Q9NXG2
  ENST ID: ENST00000381337
  CDS Start-End: 346-1407
aggaacaggtaccaaggttgggtggaagaagctatatggctggagccagcttcaagggcttgaggagccaccgacaccacttccagaatggctgctatgctgcctctactggattcaggttgcagtcgggaggcggggcaggaggcggggcttgggcgggtatcactccacccctttcacgattgcagaccggccttaggacctggcgcagcacggaatgaggcttcgaggccggctaggggaggccgtcgctcatatccgacgtcaccagttcgcgccggcgatagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaaatcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 191082 - DNA, 2624 bp, Homo sapiens
  Payload ID: 17747
  Gene Name: THUMP domain containing 1
  Uniprot ID: Q9NXG2
  ENST ID: ENST00000396083
  CDS Start-End: 58-1119
cgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgttttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaaaca

SEQ ID NO: 191083 - DNA, 1099 bp, Homo sapiens
  Payload ID: 17747
  Gene Name: THUMP domain containing 1
  ENST ID: ENST00000565248
  CDS Start-End: 65-502
cgatagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggataggaaaacaacagcatggtgttacggttggataactcaggacatcacaaaaatgttaacaacggtgtctacctaaacagtcatttctagtgcaagcagtaataatgatgaaaagttaaaatatattagatacattatagtacgtattaggcactgaagaaatactgtttggaaagaatgactagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatggga

SEQ ID NO: 191084 - DNA, 2089 bp, Homo sapiens
  Payload ID: 17748
  Gene Name: THUMP domain containing 2
  Uniprot ID: Q9BTF0
  ENST ID: ENST00000378727
  CDS Start-End: 29-940
gaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttatcgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcctgt

SEQ ID NO: 191085 - DNA, 1970 bp, Homo sapiens
  Payload ID: 17748
  Gene Name: THUMP domain containing 2
  Uniprot ID: Q9BTF0
  ENST ID: ENST00000505747
  CDS Start-End: 29-1540
gaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttatcgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcctgtaa

SEQ ID NO: 191086 - DNA, 996 bp, Homo sapiens
  Payload ID: 17748
  Gene Name: THUMP domain containing 2
  ENST ID: ENST00000510781
  CDS Start-End: 1-876
gtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggtcctgtacatgggattgtcaccaggacctagactgcaaatgcacatgaggtctcagcaatgtagagaagagcgaacaccacaaactgttgccatcaccagacctcatcagttggcccttacaaagttcagtgatgttaaaggccattggtctgaatactttatcaaccttaaaatcagtcaaaccctaaagggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaa

SEQ ID NO: 191087 - DNA, 1561 bp, Homo sapiens
  Payload ID: 17748
  Gene Name: THUMP domain containing 2
  ENST ID: ENST00000530522
  CDS Start-End: 1-267
gagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacagga

SEQ ID NO: 191088 - DNA, 3961 bp, Homo sapiens
  Payload ID: 17749
  Gene Name: THUMP domain containing 3
  Uniprot ID: Q9BV44
  ENST ID: ENST00000345094
  CDS Start-End: 335-1858
gcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagtacactaaggtgtgtgttttcaaaaccaaacacaaacctgtcaagagtatttgttggctagtttcttaaaaggccaagagaaaaaaaatgatatatctttggaaaacttttaatttgggagttatgtgagttgttactttctcctggatcacgattcacatttaattgcttttccagttgcaacaagtccttcttgagagttttgtggaaaatggtgcttccctggaacaaagagtagttgaggtttttttgtggaactcatcatagtattgtttattttggagcctctggctgcaatcagtatagattttcagtatcctattagtattataatagtactcctcttaatactttctgatgtctccattgagaataaaaggacacaatacttttgaaagaagagttcacattagcagcacagccagcaatcctcatctggtttctctgatctcctaccccacacttcataatgaatgggaaataagatgtttatgaaggttttatatcctagactggcctttttaccactatcagaattcacagctgctttgtttatgggccgaacacaaaacttttcacctgatgggagaaaccatttaaacctcaaattaagcaacccacagaaccaggaagttcaaggaccatgtctgttttcaccacgatgtctttccccacccccccaccccccactccaccccccactaagggcagggtattgtatctgccagactgggtatttgttgaacaagcgagtattttcgcctattagcttagtttttaaggaaatcattttttacttgattcatcatagctttaattctattacatactacaataaaaatttgacaagactgatacaaatatgtagtgggcaatagtttgccgtcttcttccctagtatggtgtttttcaatctggtgactagaataggcagtgggctataagcaggattcataaggcctggagctgagttatatgtgacactgccacctattcattgtgtgaccttggttttaaccttcaaagtgggtctcctggactaaaagaatgtgaaaagatggggaaataaatctgtaatctgaacatggaa

SEQ ID NO: 191089 - DNA, 2877 bp, Homo sapiens
  Payload ID: 17749
  Gene Name: THUMP domain containing 3
  Uniprot ID: Q9BV44
  ENST ID: ENST00000452837
  CDS Start-End: 340-1863
agtgctcggcaaggggaagcactctctaaacgttagcaaataccatggtaggacacaaggcccctgactctccgctttcagcttactgaagatcctcaaaaccaacagcacacagcttccagcgcatgctcctttccccaagaccttgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagt

SEQ ID NO: 191090 - DNA, 708 bp, Homo sapiens
  Payload ID: 17749
  Gene Name: THUMP domain containing 3
  ENST ID: ENST00000441127
  CDS Start-End: 1-698
caaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaagggtaaaaatttaaaa

SEQ ID NO: 191091 - DNA, 730 bp, Homo sapiens
  Payload ID: 17749
  Gene Name: THUMP domain containing 3
  ENST ID: ENST00000417036
  CDS Start-End: 609-730
tcctttccccaagaccttgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattgg

SEQ ID NO: 191092 - DNA, 704 bp, Homo sapiens
  Payload ID: 17749
  Gene Name: THUMP domain containing 3
  ENST ID: ENST00000419437
  CDS Start-End: 335-704
ggcggcttccggcggcgtgacctgaccgcaagaggccaatggagtgtgggagctgaaagggtcttcgctggcggccgggcctcactgtgtcacccaggctggagtgcagtcctcccacctcagcctcccaagtagctggactccaggcgcccaccaccacgcccagctattttttgtgtttttggtagagatgagattttgccatcttacgcagattggtctcgaactcttggcctcaagcaatctactcacctcagctccctaaagtgctgggattacaggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaac

SEQ ID NO: 191093 - DNA, 807 bp, Homo sapiens
  Payload ID: 17749
  Gene Name: THUMP domain containing 3
  ENST ID: ENST00000416603
  CDS Start-End: 1-807
gagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcagcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaag

SEQ ID NO: 191094 - DNA, 2390 bp, Homo sapiens
  Payload ID: 17749
  Gene Name: THUMP domain containing 3
  Uniprot ID: Q9BV44
  ENST ID: ENST00000515662
  CDS Start-End: 685-2208
gggagctgaaagggtcttcgctggcggccggtaactggcggcggttgggaacggccgagtgtggctcttctggtgtttcagcttggggagagaggggtggccttcctcttgcagttgaggccggcgccgagccggacttcaggcggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggtattctgtactcaattaagttattttgagtcacagaccttttgaaaatctcgtgtaagctatggcccctccacctctctaatacttcccccggcccccaccccaagcacacacaaaagcttatgcataggaaatttgttttactatttcggattacttccaagatctctctcctgatgcccatctatggatcccagagtctggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgtttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccagg

SEQ ID NO: 191095 - DNA, 3556 bp, Homo sapiens
  Payload ID: 17750
  Gene Name: Thy-1 cell surface antigen
  Uniprot ID: P04216
  ENST ID: ENST00000284240
  CDS Start-End: 1041-1526
actaggcagggatgagcaagaggaatggctcacccttgagagctggggtccatagcccaggtcagttctccagctctcccacttaccagccaagacaggaggtgaggattgagatgggatgaacccagcaggcggccatgggttaaaggtcgccatgaatgtaatgtgcccagcacagtgcctgctaaaaggcaacactcccttcctggtctgaagaccaaacaagcagactgtactcaggaaagccagaagaaccttccagctgtctggaccagaaggtgccagcccaggggctgaagaagacgtaatgcccagagcaaaaagcgcctgcagccccctgaagggctgggtgctctggaatagatgagggggcgaaatggggctggggaccagggacggacagggtgggtccagcacctgcctcgcttccgaagggctgctccaacactgaaaaacacccaaccagcttcctttcagaaagactggaatattccaaaacttctcactggaggctccggaggaggtgggctccagctgaaaaggaaatgtggaggcgtgggcgctcccggcctgcatcctgcacctcttacactttggttttcccacagactcctgaagaataggtcagaagaaagggttaaagccttaaaaggggaacaaccattgcggggctcagggaggaggataatgttctttgggctgccgcaccctgatccccggggtcccgaaccctcccgtccctggccaggcctgccagccacagggtgagggcccccttccgccgcaacctgccactctcacaccaatgcgggaccgccttctcttccttccccaccccccaccccaccctgccgtcctttctcccccaatctccgcctctgattggctgagcccccggctccccgctccccctctcctccatccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttctcagctctggtagttcttcagaaatgtaccctccaggcacatccactattgcgagggtgagcacgaagggtgggagatgcccatgtcctcaaggcatcacttcctaaatccaaaagcatcggcaggagaaaggactggggacaaatactgtcccttcgggagtagggagggaacactgaggcccatccctggctccttccctaaaagtagagtaaaatggaagcgagcatcctgggattgggggcaagagggggaccgcagggtagctgtgggttccaactgctgtcagagtcagagaggcagccccaagccagcctccctgctttgccagggaatttgggggaggaaggtgacagctgcccagaggctgactcatctgatatttagcactgggtaggatgattgtttctgagcatttttcttaaaggcctcagatctaaatta

SEQ ID NO: 191096 - DNA, 2050 bp, Homo sapiens
  Payload ID: 17750
  Gene Name: Thy-1 cell surface antigen
  Uniprot ID: P04216
  ENST ID: ENST00000528522
  CDS Start-End: 977-1462
tttgggaaaggagaggattggaatacggaaatggattaaggatgaggcccgccgggggcttgagagggaggaagagcagaccttctctgggtctggagccgcctgaggacacagaccagaggaaatgaatacagactgcacctccccagccgctctccacccctcccctggctcttctaccctctccagccccagacccatttcttccctttcttgctctggccattgctcccccttcccctcctagatcccaagcccgcacaacatctcaaacaagagtcctcgattcaaaagccagatgccgaccccccttcctcctggatctggctcagggcagcagctccaccccgggacagagagagcattgattgtagctgcagccgccgcgggatcctagcctcacccgtcaaggggctgagcgccagggaccctgaactcgtctagtggtgcgccctgcgcacccgggcgcactcaaccgaggcaatgccctgcgcgctctcgcgggtgcacgccccttctgtggcctctcctgggcgagcactgctctgcagataggctagactaccggctccgcgtcgcctcgccaagggttggttcagccaaggctgcaaaaaacaaaaaaagaccaggcagacagcctatccagggtggctattgaaactgggctggaaaactgcagtcccaggaactccagagagctggacattgggaagcatccttggctcacatacaatcggagatcactatgtctttctctcctccaggaacacgattagcttgtgtcctatccagataggaatagatgctccctatctgggagcatccttagctatggtgaatggtatctagccatccactggggatggcgagtgacttagggatttgtgtctcacgtatatgaagcagtcatcgccagatgttggttgtttttcttaacccccatcataacccgatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaacc

SEQ ID NO: 191097 - DNA, 897 bp, Homo sapiens
  Payload ID: 17750
  Gene Name: Thy-1 cell surface antigen
  ENST ID: ENST00000528295
  CDS Start-End: 85-198
agcaaccggaggcggcggcgcgtctggaggaggctgcagcagcggaagaccccagtccagatccaggactgagatcccagaaccatgaacctggccatcagcatcgctctcctgctaacaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgagg

SEQ ID NO: 191098 - DNA, 581 bp, Homo sapiens
  Payload ID: 17750
  Gene Name: Thy-1 cell surface antigen
  ENST ID: ENST00000524970
  CDS Start-End: 85-581
agcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagaggccacggatttcatgtccctgtgactggtggggcccatggaggagacaggaagcctcaagttccagtgcagagatcctacttctctgagtcagctgaccccctccccccaatccctcaaacctt

SEQ ID NO: 191099 - DNA, 570 bp, Homo sapiens
  Payload ID: 17750
  Gene Name: Thy-1 cell surface antigen
  ENST ID: ENST00000524659
  CDS Start-End: 113-570
cagaatcagaaagctgttaagcaggaaggagtgcgctgccatgaagaggcagacagaagccagagccagtgtgtctggaatgcatcagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcct

SEQ ID NO: 191100 - DNA, 578 bp, Homo sapiens
  Payload ID: 17750
  Gene Name: Thy-1 cell surface antigen
  ENST ID: ENST00000580275
  CDS Start-End: 111-545
aaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctc

SEQ ID NO: 191101 - DNA, 736 bp, Homo sapiens
  Payload ID: 17751
  Gene Name: thymic stromal lymphopoietin
  Uniprot ID: Q969D9
  ENST ID: ENST00000344895
  CDS Start-End: 200-679
gcagccagaaagctctggagcatcagggagactccaacttaaggcaacagcatgggtgaataagggcttcctgtggactggcaatgagaggcaaaacctggtgcttgagcactggcccctaaggcaggccttacagatctcttacactcgtggtgggaagagtttagtgtgaaactggggtggaattgggtgtccacgtatgttcccttttgccttactatatgttctgtcagtttctttcaggaaaatcttcatcttacaacttgtagggctggtgttaacttacgacttcactaactgtgactttgagaagattaaagcagcctatctcagtactatttctaaagacctgattacatatatgagtgggaccaaaagtaccgagttcaacaacaccgtctcttgtagcaatcggccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagta

SEQ ID NO: 191102 - DNA, 2621 bp, Homo sapiens
  Payload ID: 17751
  Gene Name: thymic stromal lymphopoietin
  ENST ID: ENST00000420978
  CDS Start-End: 1423-1902
gaagttggtgatgggggaagagtggacttttttttcaaagaatgctgtggtgactcgagtacaacacatgaagaattccagaaaagagccatttttgaagtcagcggtgaatcagaggttttctgaccctctcgagtgccttctatgaagaagagttcaactctggctccagtttgtcccctactcttttcccgaatccctcgacattccttgctcttttccccaggcaccgcatggcctgtgacatttgctgggactcacacacggcgtccaacctcctttctccgagcgatgactcctaggaacttcccaaggaccagagcgatgcaggctccgacacgcgagggcggggggcgggggtgaggggtgcgatggacgggggagcggaagggaaagagagagagaggggacctgggtgtagagagggcccagggccgcatgagccaagccagggaggagcagggggttcatctcagcaacctgatcggtgtcggcctttccctcccttcaaccctccattggtgttgctggaactgggaagactgctagacagacatcctctagggcactctccctgactcactttgctgtgcttttaagcgctcttttctggatcaacaagagtttgctagtaaaaatctgagcccgccatctcgatgcttctcctgtctctaaaactggtgcccgggctgaggccccaggtgacagacgttttccagtctacgctgcgcggggctaagcctctgcgaggcagagcgcactaaagcgtgcgccgcctccgggagagctgagctcaggacagcatcgtctccgtgcggtcgccgctgggcacccagcagcgcggtctggctccgcttcttgtgtcgctggccttaagagtgggactgtgaaggtggctgggcgctggaatttgtggttttaaaagttcttgacacctgctagaaagtgctagaggactcttcagcccctaaggtgcccctagccaccaagagtaggcgtttttcctgaaattgatatgggaaatttgaaaagtagggtttttgagaacaagccacatcagatctttccccacttatttcaacctcttatcgttcctgcccctaaggttctggtcacggttgcacatttaatgctttcacatggaagtgctgtcgaagactgagactgcaccccaccctccaaagcatcccataagcaagcacagtttcttactagccaaggagaagggaaagcactagttgaaagtggccacaggaaatgctcaaagatgttcagaatgcatgggacatatgcaaggactccaaatccttacagtggctgctggtttcagaaggtgtttctcccaaatagaaaggattggtcacggaaatgccctgtaggagaaagacactggtatccgtttcttaaaggacattcacacttatgaagtgtttagggcaaagcaaaaaggaggaagtttctttcaggaaaatcttcatcttacaacttgtagggctggtgttaacttacgacttcactaactgtgactttgagaagattaaagcagcctatctcagtactatttctaaagacctgattacatatatgagtgggaccaaaagtaccgagttcaacaacaccgtctcttgtagcaatcggccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttg

SEQ ID NO: 191103 - DNA, 2411 bp, Homo sapiens
  Payload ID: 17751
  Gene Name: thymic stromal lymphopoietin
  Uniprot ID: Q969D9
  ENST ID: ENST00000379706
  CDS Start-End: 270-461
accctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcagataaatgctactcaggcaatgaagaagaggagaaaaaggaaagtcacaaccaataaatgtctggaacaagtgtcacaattacaaggattgtggcgtcgcttcaatcgacctttactgaaacaacagtaaaccatctttattatggtcatatttcacagcaccaaaataaatcatctttattaagtagatgaaacattaactctaactgtgacaaagaagaccacaaatagttatcttttaattacagaagagtttcttaacttacttttgtaagtttttattgtgtaagtttataatgcaggggaagtactactcctcaaatgttgagggaagcttccataacattgatgactggcttcatggcagtaattctcggctgtagttgcataagcattgctcaagaggaaaatccaaaagtgcagcaggagaactcttttccctgaaaaaggaaaaatattgaactcaatgatagcacctaaacttacatttaaaagacagacattccttctacatgtaatgacacttcttgtgttaaactaaaaatttacaagagaagaaagtgaaagcaaatggggtttcacaaatagttgtaaatatagtgaagcaatttgaaataattttcaagcaaagtattgtgaaagtattctaagccaagttttaaatattatctaacagacaagagtggtatatacaagtagatcctgagaagtacctttgttacagctactataaatatacatataaattatagaatctactttaatttattttgtgaacacttttgaaaatgtacatgttcctttgtaattgacactatatatttcttaataaaataattctcaaatttgtttcttatgaatcatctctcaaatctagttagacaatttgcacacatacttttctaagggacattatcttccttcaggtttttacctccactcatccttagagcccactgactgctcccctttatacctgttggccctgcctataggagagaatatttggagataggcagcttcaggatgcattgcaatcatccttttcttaaattatgtcactagtcttttattttttcccctcttgaactttcctcacacctggaagaaacaaagtaggaaaaagtgaacaggggatgtcaaatcgattcttgaattcccgctgcaagctagagccgcaggcaccctctcactcaatttccactcagaaccctataaacaccagtgggaagggcaacccactgcacgtgggaatgcactgatttttcctaggagtagacatgttcctctaattactccctgagggttagttggggctaaaccatgacagaagtggggaagttcaatgtccttaaatccatcttacttgccaacaggtaagaggaagcttacattacatgtccagtccacatttaaagagcacttactgtggaacaagccttcagccaaacaatggggatagaaaagtaggtaagactcagcctttgtccagagaagctcagggtatagctgaataggcagtttcttttgtcctgaggaaaatcaggacatgcctgctttctaaaaatcttcctctgaagacctgacccaagctcttaaatgctattgtaagagaaatttctttgtctattaactccattttagtagggattcactgactagattttactgaactatgaaaataaatacacataatttttcacaaaattttgggcccaattcccctaaaagaattgaggattagggagaaaggagacaactcaaagtcatcccattaagtgcagtttctttgaatcttctgctttatctttaaaaatttgtataatttatatattttattctatgtgttccatagatatcttaatgtaaaattagtcatttaaattacactgtcaattaaaagtaatgggcaagagattgcatcatactaatttagtaagaacgttcccaaatgttgtaacaatgtggatcatacatctctggttttttaaatgtattgaggctttcttggtggactagtatagtatacggtcagttatgtcaatgtttcatggtcaataaaaaggaagttgcaaattgt

SEQ ID NO: 191104 - DNA, 1628 bp, Homo sapiens
  Payload ID: 17752
  Gene Name: thymidine kinase 1, soluble
  Uniprot ID: P04183
  ENST ID: ENST00000301634
  CDS Start-End: 240-944
cctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggacgca

SEQ ID NO: 191105 - DNA, 683 bp, Homo sapiens
  Payload ID: 17752
  Gene Name: thymidine kinase 1, soluble
  ENST ID: ENST00000590430
  CDS Start-End: 45-308
cggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccgttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagc

SEQ ID NO: 191106 - DNA, 631 bp, Homo sapiens
  Payload ID: 17752
  Gene Name: thymidine kinase 1, soluble
  ENST ID: ENST00000586613
  CDS Start-End: 70-631
cgggaaccaggggcttactgcgggacggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccgaactcgaagtaggattatagcaaggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagaca

SEQ ID NO: 191107 - DNA, 1681 bp, Homo sapiens
  Payload ID: 17752
  Gene Name: thymidine kinase 1, soluble
  ENST ID: ENST00000588734
  CDS Start-End: 240-1043
cctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgt

SEQ ID NO: 191108 - DNA, 642 bp, Homo sapiens
  Payload ID: 17752
  Gene Name: thymidine kinase 1, soluble
  ENST ID: ENST00000590862
  CDS Start-End: 43-585
gccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggagcagattctgcaatgcagccctgccaactgagggacctgcgagggccgcccgctcccttcctgccactgccgcctactggacgctgcc

SEQ ID NO: 191109 - DNA, 5114 bp, Homo sapiens
  Payload ID: 17753
  Gene Name: thymidine kinase 2, mitochondrial
  Uniprot ID: O00142
  ENST ID: ENST00000299697
  CDS Start-End: 352-1149
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 191110 - DNA, 1046 bp, Homo sapiens
  Payload ID: 17753
  Gene Name: thymidine kinase 2, mitochondrial
  ENST ID: ENST00000417693
  CDS Start-End: 4-873
gaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgagggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgt

SEQ ID NO: 191111 - DNA, 3738 bp, Homo sapiens
  Payload ID: 17753
  Gene Name: thymidine kinase 2, mitochondrial
  ENST ID: ENST00000451102
  CDS Start-End: 226-1149
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaa

SEQ ID NO: 191112 - DNA, 2687 bp, Homo sapiens
  Payload ID: 17753
  Gene Name: thymidine kinase 2, mitochondrial
  Uniprot ID: O00142
  ENST ID: ENST00000527800
  CDS Start-End: 957-1463
gggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 191113 - DNA, 1178 bp, Homo sapiens
  Payload ID: 17753
  Gene Name: thymidine kinase 2, mitochondrial
  Uniprot ID: O00142
  ENST ID: ENST00000525974
  CDS Start-End: 417-923
tttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatg

SEQ ID NO: 191114 - DNA, 1937 bp, Homo sapiens
  Payload ID: 17753
  Gene Name: thymidine kinase 2, mitochondrial
  Uniprot ID: O00142
  ENST ID: ENST00000527284
  CDS Start-End: 9-713
gccaagttatgggtgcgttctgccagcgtcctagcagtgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcatt

SEQ ID NO: 191115 - DNA, 1120 bp, Homo sapiens
  Payload ID: 17753
  Gene Name: thymidine kinase 2, mitochondrial
  Uniprot ID: O00142
  ENST ID: ENST00000545043
  CDS Start-End: 62-784
agtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgta

SEQ ID NO: 191116 - DNA, 3441 bp, Homo sapiens
  Payload ID: 17753
  Gene Name: thymidine kinase 2, mitochondrial
  Uniprot ID: O00142
  ENST ID: ENST00000544898
  CDS Start-End: 55-852
cgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaa

SEQ ID NO: 191117 - DNA, 1156 bp, Homo sapiens
  Payload ID: 17753
  Gene Name: thymidine kinase 2, mitochondrial
  ENST ID: ENST00000564917
  CDS Start-End: 46-894
tcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggtggggtctgctctgtccactcccgacagactgcttgtgtttccctggcaggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgt

SEQ ID NO: 191118 - DNA, 2266 bp, Homo sapiens
  Payload ID: 17753
  Gene Name: thymidine kinase 2, mitochondrial
  ENST ID: ENST00000567357
  CDS Start-End: 27-389
agtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgagacggcgtcttgctgtgttgcccaggctggcctccaactcctgggctcaagtgatcctctggcatcagcctcctgagtagctgtgatgacaagtatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagc

SEQ ID NO: 191119 - DNA, 753 bp, Homo sapiens
  Payload ID: 17753
  Gene Name: thymidine kinase 2, mitochondrial
  ENST ID: ENST00000563478
  CDS Start-End: 363-753
cagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttcccca

SEQ ID NO: 191120 - DNA, 822 bp, Homo sapiens
  Payload ID: 17753
  Gene Name: thymidine kinase 2, mitochondrial
  ENST ID: ENST00000561905
  CDS Start-End: 1-68
atgaggagtggctcatcaaaggcagccttttccccatggcagcccctgttctggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 191121 - DNA, 553 bp, Homo sapiens
  Payload ID: 17753
  Gene Name: thymidine kinase 2, mitochondrial
  ENST ID: ENST00000562484
  CDS Start-End: 288-553
gctctcgcgcatgcgccccaacgggatcccgcggccgtccgctctggcttgtgctgtctttcagttatcgcgtagcacattagcggacctagagctgggcacatattagcggacctagagataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcc

SEQ ID NO: 191122 - DNA, 882 bp, Homo sapiens
  Payload ID: 17753
  Gene Name: thymidine kinase 2, mitochondrial
  Uniprot ID: O00142
  ENST ID: ENST00000563369
  CDS Start-End: 362-868
gcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtct

SEQ ID NO: 191123 - DNA, 749 bp, Homo sapiens
  Payload ID: 17753
  Gene Name: thymidine kinase 2, mitochondrial
  ENST ID: ENST00000569718
  CDS Start-End: 1-428
gccagcgtcctagcagtgataaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaaggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcag

SEQ ID NO: 191124 - DNA, 5060 bp, Homo sapiens
  Payload ID: 17753
  Gene Name: thymidine kinase 2, mitochondrial
  Uniprot ID: O00142
  ENST ID: ENST00000620035
  CDS Start-End: 352-1095
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccgataaagaacaggaaaaagagaaaaaatcagtgatctgtgtcgagggcaatattgcaagtgggaagacgacatgcctggaattcttctccaacgcgacagacgtcgagggcctgatgtaccacgatgcctctcgctggggtcttacgctacagacttatgtgcagctcaccatgctggacaggcatactcgtcctcaggtgtcatctgtacggttgatggagaggtcgattcacagcgcaagatacatttttgtagaaaacctgtatagaagtgggaagatgccagaagtggactatgtagttctgtcggaatggtttgactggatcttgaggaacatggacgtgtctgttgatttgatagtttaccttcggaccaatcctgagacttgttaccagaggttaaagaagagatgcagggaagaggagaaggtcattccgctggaatacctggaagcaattcaccatctccatgaggagtggctcatcaaaggcagccttttccccatggcagcccctgttctggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtccccccgcctggggaatatatcagtcagaacaatcttcctgcagacatgcaccattagacccgagtgacggtggtgccatttaaacctcagagcaggtaaaaggtggtcctgaaacctgtctacccacagggtgctatggaatctgaatcacttcttttttcctagagccctggggtggggagctccctcaagtgttcacatgtgtgtggaatgaggaacacccatctccttggccctctccaccctgaagagttagttattaaaataattggcaagctcttgcaaatgtcagtcatccattgttcagaatggaatagcaataatacatccctggctgccctgggcttggccaggattactcactgaaggcctcagggttactggcacacactttcttttcctaataatcccatcccctcagctttcctaaggctagagtgaatttcgtgttcctttagtttacataagatggtgaacttggcaaaagctatcattaaacagaagctaagagaaagcctatgtcgtggaatccagaatgggtattgccattcactgctgtccacagaagctgtcttgaatttctttctgtgtcttttctttttttttctttaagactgttgtttaccagactgggctctgtggaacacaggtgtcctgggagatggttaatcattacaaaatattggtaacaatctaaagatgcatacataagagagtggtcaaataaaccattttccattca

SEQ ID NO: 191125 - DNA, 1630 bp, Homo sapiens
  Payload ID: 17754
  Gene Name: thymidine phosphorylase
  Uniprot ID: P19971
  ENST ID: ENST00000252029
  CDS Start-End: 164-1612
cccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 191126 - DNA, 1614 bp, Homo sapiens
  Payload ID: 17754
  Gene Name: thymidine phosphorylase
  Uniprot ID: P19971
  ENST ID: ENST00000395678
  CDS Start-End: 152-1600
gccgccgccccgccgccggcagtggaccgctgtgcgcgaaccctgaaccctacggtcccgacccgcgggcgaggccgggtacctgggctgggatccggagcaagcgggcgagggcagcgccctaagcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgc

SEQ ID NO: 191127 - DNA, 1608 bp, Homo sapiens
  Payload ID: 17754
  Gene Name: thymidine phosphorylase
  Uniprot ID: P19971
  ENST ID: ENST00000395680
  CDS Start-End: 142-1590
gcgcgaaccctgaaccctacggtcccgacccgcgggcgaggccgggtacctgggctgggatccggagcaagcgggcgagggcagcgccctaagcaggccgcagaccccggacgtgtcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 191128 - DNA, 1604 bp, Homo sapiens
  Payload ID: 17754
  Gene Name: thymidine phosphorylase
  Uniprot ID: P19971
  ENST ID: ENST00000395681
  CDS Start-End: 123-1586
ggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatgcccctctccccgcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 191129 - DNA, 1432 bp, Homo sapiens
  Payload ID: 17754
  Gene Name: thymidine phosphorylase
  ENST ID: ENST00000425169
  CDS Start-End: 98-1432
ctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctg

SEQ ID NO: 191130 - DNA, 1327 bp, Homo sapiens
  Payload ID: 17755
  Gene Name: thymidylate synthetase
  Uniprot ID: P04818
  ENST ID: ENST00000323224
  CDS Start-End: 1-840
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaag

SEQ ID NO: 191131 - DNA, 693 bp, Homo sapiens
  Payload ID: 17755
  Gene Name: thymidylate synthetase
  Uniprot ID: P04818
  ENST ID: ENST00000323250
  CDS Start-End: 1-693
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 191132 - DNA, 1662 bp, Homo sapiens
  Payload ID: 17755
  Gene Name: thymidylate synthetase
  Uniprot ID: P04818
  ENST ID: ENST00000323274
  CDS Start-End: 140-1081
cgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaa

SEQ ID NO: 191133 - DNA, 1602 bp, Homo sapiens
  Payload ID: 17756
  Gene Name: thymine DNA glycosylase
  ENST ID: ENST00000266775
  CDS Start-End: 280-1500
acagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagtttgcattttcatgaagtgctcaaaatgggacatgtgaaattctgagagtagtagtaagaaacatgggagagtgctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttact

SEQ ID NO: 191134 - DNA, 3251 bp, Homo sapiens
  Payload ID: 17756
  Gene Name: thymine DNA glycosylase
  Uniprot ID: Q13569
  ENST ID: ENST00000392872
  CDS Start-End: 235-1467
agtacgcgtgggatttggctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaa

SEQ ID NO: 191135 - DNA, 824 bp, Homo sapiens
  Payload ID: 17756
  Gene Name: thymine DNA glycosylase
  ENST ID: ENST00000436021
  CDS Start-End: 410-824
ctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagagtttcactctgttgcccaagatggagtacagtggtgcgatcaccgttcactgcaacctctgcttcccgagtttaagcgattctcatgcctcagcctcccaagcatctgggactacagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgt

SEQ ID NO: 191136 - DNA, 923 bp, Homo sapiens
  Payload ID: 17756
  Gene Name: thymine DNA glycosylase
  ENST ID: ENST00000537100
  CDS Start-End: 153-923
ggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaact

SEQ ID NO: 191137 - DNA, 1014 bp, Homo sapiens
  Payload ID: 17756
  Gene Name: thymine DNA glycosylase
  ENST ID: ENST00000540956
  CDS Start-End: 1-334
aattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccaggtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatg

SEQ ID NO: 191138 - DNA, 1387 bp, Homo sapiens
  Payload ID: 17756
  Gene Name: thymine DNA glycosylase
  ENST ID: ENST00000544861
  CDS Start-End: 480-1283
acagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactct

SEQ ID NO: 191139 - DNA, 1898 bp, Homo sapiens
  Payload ID: 17757
  Gene Name: thymocyte expressed, positive selection associated 1
  Uniprot ID: A2RU30
  ENST ID: ENST00000316577
  CDS Start-End: 111-1676
aagtgtggcaggaggaaggctgtatgatataaaggaagaaagcatgcatctggaactcagaacttgacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctg

SEQ ID NO: 191140 - DNA, 2010 bp, Homo sapiens
  Payload ID: 17757
  Gene Name: thymocyte expressed, positive selection associated 1
  Uniprot ID: A2RU30
  ENST ID: ENST00000449076
  CDS Start-End: 134-1699
gcttcacctctgtgcccacacctgtgaaggcctcggcccagcttcgacaactgctttgcctcaaactcagctttctaccagcagacaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgat

SEQ ID NO: 191141 - DNA, 2000 bp, Homo sapiens
  Payload ID: 17757
  Gene Name: thymocyte expressed, positive selection associated 1
  Uniprot ID: A2RU30
  ENST ID: ENST00000532804
  CDS Start-End: 537-1688
tatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggcaaattaaatactactgactctcactggaaaagaatatgaatatgtgtgagtttttccatgaaaaagctccttggaaaatgtagtaagtgacttcaacctataagactgtttttggtttagatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgata

SEQ ID NO: 191142 - DNA, 1517 bp, Homo sapiens
  Payload ID: 17757
  Gene Name: thymocyte expressed, positive selection associated 1
  Uniprot ID: A2RU30
  ENST ID: ENST00000531122
  CDS Start-End: 328-1479
ttttatatacggtgtattcctctcatatcttaaagaaaagctttatgtagaaaaaaagattcatgacgcagcttatggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacag

SEQ ID NO: 191143 - DNA, 582 bp, Homo sapiens
  Payload ID: 17757
  Gene Name: thymocyte expressed, positive selection associated 1
  ENST ID: ENST00000526532
  CDS Start-End: 341-582
agttctcacagtgatctagtgtctgacttttctagggaatccaatcaataaaattgaagactggctgcaggattgcggctccttggaaaatgtagtaagtgacttcaacctataagactgtttttggtttagatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccag

SEQ ID NO: 191144 - DNA, 523 bp, Homo sapiens
  Payload ID: 17757
  Gene Name: thymocyte expressed, positive selection associated 1
  ENST ID: ENST00000533607
  CDS Start-End: 381-523
cttttgagcaggcaacagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggccctactctagtgtccatagctccaaccattgagagtacctggctgaaatcaactttgctttctgtgggtatgacctctttcttcagaagctgtagaagaaacttgttgagataaactgcagcaagatatattgaggtcagctacgagggaggatgtacacacttgagtgaggacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcct

SEQ ID NO: 191145 - DNA, 655 bp, Homo sapiens
  Payload ID: 17757
  Gene Name: thymocyte expressed, positive selection associated 1
  ENST ID: ENST00000525978
  CDS Start-End: 1-242
aggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggcaaattaaatactactgactctcactggaaaagaatatgaatatgtgtgagtttttccatgaaaaagctccttggaaaatgtagtaagtgacttcaacctataagactgtttttggtttagatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctc

SEQ ID NO: 191146 - DNA, 1861 bp, Homo sapiens
  Payload ID: 17757
  Gene Name: thymocyte expressed, positive selection associated 1
  ENST ID: ENST00000524923
  CDS Start-End: 316-519
agttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaagccttaattttctcccaagctttgacattgccaagggcagttaggagacttcaggatcaagtttaggggacaagtttttttctaatactttcaaaaggcccaagtgaagagagga

SEQ ID NO: 191147 - DNA, 4188 bp, Homo sapiens
  Payload ID: 17757
  Gene Name: thymocyte expressed, positive selection associated 1
  Uniprot ID: A2RU30
  ENST ID: ENST00000524622
  CDS Start-End: 663-1814
atgagaccacagtcataagagtaaaacaaaaattctgatggaaataaatgcttatttggtaggaagcaaaaagcacaaaaacaagattgtctttctttttctttttctttttaaatgagaaggatccacccttgtgggaaaggaactctcaaaagacagcagtgggcctgacatcttgggcactttccaggttcttgggaggaagggagaaaagaagcagagagagagaagaaatatctactatttttatatacggtgtattcctctcatatcttaaagaaaagctttatgtagaaaaaaagattcatgacgcagcttatgtaagaataaacttgtggaatggaattagttgcagggaggaggtctgatttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaagactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagtaaactgaacaaagccttaattttctcccaagctttgacattgccaagggcagttaggagacttcaggatcaagtttaggggacaagtttttttctaatactttcaaaaggcccaagtgaagagaggaaggacacctcactttctggctctaaaagcatggtacatctcacactaggattccctctgcacctctgttcatccctgtattcctaactaaattccagaaaatcttctacaacactggagtcctatttttcttcttgagacctcctttgaagaaatcaacttggagactcctccttaaatccagtttctttctctacccaaaattttgcatctttatagaaaaagagataagtaggattcagagtctcttctcctagccattgtggggggaaaaaatgctatttctgttggcagaaaacaatacaaatattttttttaaatcatggcatgtttttaaagttaactaacagctgtagtttgctttggaagttaaatgttttgtcaataaacagggcttgagcacatgcagtgctctcttaggcagtatgtggtttcagagcatcttggacacatttctcccctgagaaaatattaatattaatagaatgggagaagtaagatgcacgcatttccagaagtatattatttggctgcctaataaattgtgagacaaaagaaaaaaaaaaaaaaaacaggaagagagggacttgagggaatttgagggaaatcataaccaaaagtttaaaggaaaaaattacaccagacatgataagcagaagttgattttgttctggtgctattgccagcattaggggagaaggcacaaactgagtctgatacgtagtgaggcagagacaaaagggctagggtggaaaaatttttaaaccatctgtgtttactaattccccataccaaaagaacaaaatgaactttctcctatttcatgataaaagatagtttcacaatttggaaaaagcccccccactccaagtttcctacccttcccacccacagaaaccaggagacaggggaactatcttccttgatgttaacatttcaaagaggtggttctcaggtcctagagaaagatattcctgagttgtaaaactgggaagaggctggaagaagatttagatctcaagaaatagaaagaactacagcaaattttctaaagcaaatattcttaagggaggtcaagggcctgaagtcaggaagaaacctatttggtcaagctgaggggaaagttaaggctatcttgtcacaagagaacagaaatatctgacaatatttcatttaaagaactgtattagtccattctcacactgctataaataaatacctgagactgggtaatttatacagaaaagaggtttaattggctcacagttccgcaggctgtacaggaagcatggcaacatcagtttctggggaggcctcagggagctttaactcatggtggaaagcaaagtgggagcaggcatcttacatggtatgagcaggaggaacaaaggaaaggggaggtgctaacacttttaaatgaccagatcttgtaagaactcactcattatacagtaccaaggggagatggtgctaaacgattaatgaaaactctacccagtaatccaatcaccacccaccaggccccacctccaacaatggggattacagtttgacatgagatttgggtgaggacacagatccaaactgtcaggcctctgagcccaagctaagccatcatatcccctgtgacctgcatgtatacatccagatggcctgaagcaagtggagaatcacaaaagaagtgaaaatggcctgttgctgccttaacagatgacattactttgtgaaattccttcttctggctcagaagctcccccactgagcaccttgtgacccccacccctgcctgccagagaataatcccctttgactgtaattttccactacctacctaaatcctataaaacagccccacccctatctccctttgctgactctctttttggactcagcctgcctgcacccaggtgattaaaaagctttattgctcacac

SEQ ID NO: 191148 - DNA, 562 bp, Homo sapiens
  Payload ID: 17757
  Gene Name: thymocyte expressed, positive selection associated 1
  ENST ID: ENST00000533446
  CDS Start-End: 381-562
agaaaagaagcagagagagagaagaaatatctactatttttatatacggtgtattcctctcatatcttaaagaaaagctttatgtagaaaaaaagattcatgacgcagcttattgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagct

SEQ ID NO: 191149 - DNA, 592 bp, Homo sapiens
  Payload ID: 17757
  Gene Name: thymocyte expressed, positive selection associated 1
  ENST ID: ENST00000532757
  CDS Start-End: 291-592
gttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagctttctccaccaccacaacagcatgtggtctgacagaattggcttcaaagaagaaactaa

SEQ ID NO: 191150 - DNA, 783 bp, Homo sapiens
  Payload ID: 17757
  Gene Name: thymocyte expressed, positive selection associated 1
  ENST ID: ENST00000524668
  CDS Start-End: 538-783
cagcagttgaatgagttcagggagaaaggcataatctacaacatgatactttctcacttgcttcacctctgtgcccacacctgtgaaggcctcggcccagcttcgacaactgctttgcctcaaactcagctttctaccagcagacaggccctactctagtgtccatagctccaaccattgagagtacctggctgaaatcaactttgctttctgtgggtatgacctctttcttcagaagctgtagaagaaacttgttgagataaactgcagcaagatatattgaggtcagctacgagggaggatgtacacacttgagtgaggcactgcttggggcataggtacaaaacagacagaagagaagagaggtctgtctcatacatgtcccctagagcactaaaggcaaacctgggactgggccttggaaaccaagtgtggcaggaggaaggctgtatgatataaaggaagaaagcatgcatctggaactcagaacttgacggcattactgttacgggaggccctgaagtctgagccagggccatggaggcctctgtgctgagccccacatcctgggagaaacggcgggcctggctccgtcagagccgtaactggcagacccaggtcctagaagaggaggctgccgccgccctgcaggatgtcccagatcctgagccttccagcctggatgacgttttccaagaagggaatccaatcaataaaattgaagactggctgcaggattgcggatactctgaagaaggattttctgaggaagcaggacagttt

SEQ ID NO: 191151 - DNA, 580 bp, Homo sapiens
  Payload ID: 17757
  Gene Name: thymocyte expressed, positive selection associated 1
  ENST ID: ENST00000528240
  CDS Start-End: 1-450
cagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatgatagt

SEQ ID NO: 191152 - DNA, 1753 bp, Homo sapiens
  Payload ID: 17757
  Gene Name: thymocyte expressed, positive selection associated 1
  ENST ID: ENST00000620453
  CDS Start-End: 295-1479
tttcgttcagttctcacagtgatctagtgtctgacttttctagggaatccaatcaataaaattgaagactggctgcaggattgcggatactctgaagaaggattttctgaggaagcaggacagtttatctacaatggcttctgcagccatgggaccagctttgaagatgacttgaccctgggagcggaggccacactactggccgccaatggcaaactcttctccaggagtttcctcgagacagccaggccttgccagctacttgatcttggctgtagtttggcttccagcagcatgactggggggaccaacaagactagttcaagcatctcagaaattctggacaaagtgcaagaagatgcagaagatgtcctcttcagtctgggctttggccaagaggatcacaaagacacttctcggatacccgcccgatttttcaccaccccctctcaggccaagggcattgatttccagctcttcctgaagtcccaggtgcggaggattgaaatggaagacccctgcctcatgctggccagcaggtttaagcaggtgcaaacactggctgtcactgctgatgccttcttctgtctctactcctatgtgtctaagacacctgtccaaaagttcacaccatcccacatgttctggaattgcaaccatccaactgatgtgccatccatcaggattctgtcccgagagcctgaaccccagtcacccagagaccgccttcggaaagccatctccaagatgtgtctgtacacatgcccccgagaccggccaccaccaccccacaacacccccaaaaggaacagtttggaccaagttgtgttggaagtgatggacaaagtgaaagaagagaagcagttcctccagcaagactctgatttggggcaattctcacaggaagatcctgtgccccctgctgagggtaagaagttgcccacttctccctatccatgtgtcttctgctgtgaagaggaaacacagcagaggatgtccacagtgctagcaccatcccaaactctggattcgaaccccaaggtaccctgttgcacacattctctgcccatagaagatccacagtggagcacagacccagctcagataaggagagagctgtgtagtctaccagccaccaatacggaaacccatccagccaaggatgagactttctggaaaagaaagagcagagcaagaaagagcctcttccagaagaatctcatgggcaggaaggttaagtccttggacctgtccatcacccagcagaaatggaagcagagtgtagacagaccagaactgcgtcggtctttaagccagcagccacaggacacttttgacttggaggaggtgcaaagcaacagtgaggaggagcagagtcagagtcgctggcccagcagacccaggcacccccaccaccaccagacttttgctggcaaactcgtgaagctttctccaccaccacaacagcatgtggtctgacagaattggcttcaaagaagaaactaaaagccacctcttgcaggaaactgcactgccctcaacatccagcccctactccttggtcctccaaacccccaaactctgcaggagaaaggcagcatggtacatggggaggaagaccagactgagcgatttggaatccacatcctaatgctgccacaagctgcatgcacaaagaccttaggcacatctcttcatttctctgtacactggtttctctactatgtgtgtattaaaatatataatgtggatg

SEQ ID NO: 191153 - DNA, 835 bp, Homo sapiens
  Payload ID: 17758
  Gene Name: thymocyte nuclear protein 1
  Uniprot ID: Q9P016
  ENST ID: ENST00000352327
  CDS Start-End: 159-659
acagcctgcggcgcagcggaggcggaccgcagtcgagtctgcagagtgttgggtctgtagccagcaaattacttcatcatctagattatccattcagttgatcctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatgaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaa

SEQ ID NO: 191154 - DNA, 1299 bp, Homo sapiens
  Payload ID: 17758
  Gene Name: thymocyte nuclear protein 1
  Uniprot ID: Q9P016
  ENST ID: ENST00000341541
  CDS Start-End: 463-1140
tgcggcgcagcggaggcggaccgcagtcgagtctgcagagtgttgggtctgtagccagcaaattacttcatcatctagattatccattcagttgatcctaattagcaaggataacaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttggagacgttctaggctgcctctcgttgcctccatctcgctctgcgcgggttttggaggacattagcattctttcttgtatctccgttgattccagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 191155 - DNA, 943 bp, Homo sapiens
  Payload ID: 17758
  Gene Name: thymocyte nuclear protein 1
  Uniprot ID: Q9P016
  ENST ID: ENST00000392594
  CDS Start-End: 107-784
cgccgcgggggtcgcgctgcacagcctgcggcgcagcggaggcggaccgcagtcgagtctgcagagtgttggaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 191156 - DNA, 893 bp, Homo sapiens
  Payload ID: 17758
  Gene Name: thymocyte nuclear protein 1
  Uniprot ID: Q9P016
  ENST ID: ENST00000392595
  CDS Start-End: 57-734
cctaattagcaaggataacaagaatcgtccgcactaaagtcccctgcagcgtgaccatgtcgagaccccggaagaggctggctgggacttctggttcagacaagggactatcaggaaaacgcaccaaaactgagaactcaggtgaggcattagctaaagtggaggactccaaccctcagaagacttcagccactaaaaactgtttgaagaatctaagcagccactggctgatgaagtcagagccagagagccgcctagagaaaggtgtagatgtgaagttcagcattgaggatctcaaagcacagcccaaacagacaacatgctgggatggtgttcgtaactaccaggctcggaacttccttagagccatgaagctgggagaagaagccttcttctaccatagcaactgcaaagagccaggcatcgcaggactcatgaagatcgtgaaagaggcttacccagaccacacacagtttgagaaaaacaatccccattatgacccatctagcaaagaggacaaccctaagtggtccatggtggatgtacagtttgttcggatgatgaaacgtttcattcccctggctgagctcaaatcctatcatcaagctcacaaagctactggtggccccttaaaaaatatggttctcttcactcgccagagattatcaatccagcccctgacccaggaagagtttgattttgttttgagcctggaggaaaaggaaccaagttaactgagatactgctgctggaatgggcgagacattgctgcaaagaagtcaagcttttttcagacaaaaggtgtgagggggcttgcttggtatgcttacctgggcttgtgtacctcagtggtttttgtgtacttttttcaataaaatatcaaagttgaagaa

SEQ ID NO: 191157 - DNA, 3866 bp, Homo sapiens
  Payload ID: 17759
  Gene Name: thymocyte selection associated
  Uniprot ID: Q8N1K5
  ENST ID: ENST00000368248
  CDS Start-End: 150-2075
agctactccaccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgta

SEQ ID NO: 191158 - DNA, 4101 bp, Homo sapiens
  Payload ID: 17759
  Gene Name: thymocyte selection associated
  Uniprot ID: Q8N1K5
  ENST ID: ENST00000368250
  CDS Start-End: 263-2188
tgagaggctcttcctggatcccttattttctacaggagaggaggaaaacacctgggatgctccagtgctcttacgcagataatgatcattaacatcagcctctctgatcaaagagctactccaccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgtatgtgttctcttctatgtttaactctagaataactatcttcctgtaacgattaagttaaaatattctttaactagaattgaaataaattgttcactaaggagggggctgcttgtgctaaaaaa

SEQ ID NO: 191159 - DNA, 631 bp, Homo sapiens
  Payload ID: 17759
  Gene Name: thymocyte selection associated
  ENST ID: ENST00000434358
  CDS Start-End: 1-631
gtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccagttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacct

SEQ ID NO: 191160 - DNA, 3830 bp, Homo sapiens
  Payload ID: 17759
  Gene Name: thymocyte selection associated
  Uniprot ID: Q8N1K5
  ENST ID: ENST00000537166
  CDS Start-End: 219-2039
ttcacagataaagtgttctgcagactcaaggtttatacttacaattacgagatttatatttgcattagtctctttggctggtgggtaggggtgagaggctcttcctggatcccttattttctacaggagaggaggaaaacacctgggatgctccagtgctcttacgcagataatgatcattaacatcagcctctctgatcaaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaactttagaacaaaaaaaattagagttttttcaatgtttatattctgattaagcttactttaccttacattttttctaagtaacaatgaatcctgatttctagtgtcctaaaaattgcttagtgatttgattgtggtaatatcatttcttatctacaatgtctaaagttttatgggacagtttttcttttatttattttgcctgtttgtgcagataagaacagaaacttttctaagacccacatttggttattgaaggccacagcgaatcttaacctaacagccttgacaaactgcaccataggtgtttttagactcatataatttgttatttttcaaacaatagtgaataattaatatttttgtttggaatttgagaacaattaaatttgtacttttagtaactaccattctttgattagaaaattaagagaatgcatatcttactttggttgtaaattatcaagggctttctaatagaaatcatatataacatttctaaatataagtcctttcacatactgtgtttccagttgtcttgatattgaaaagtgtaataaacttcatgctcacctattggagatttgggaaggttgaaaataaacttcctaatttttatttgta

SEQ ID NO: 191161 - DNA, 4101 bp, Homo sapiens; identical to SEQ ID NO: 191158
  Payload ID: 17759
  Gene Name: thymocyte selection associated
  Uniprot ID: Q8N1K5
  ENST ID: ENST00000610842
  CDS Start-End: 263-2188

SEQ ID NO: 191162 - DNA, 3866 bp, Homo sapiens; identical to SEQ ID NO: 191157
  Payload ID: 17759
  Gene Name: thymocyte selection associated
  Uniprot ID: Q8N1K5
  ENST ID: ENST00000613862
  CDS Start-End: 150-2075

SEQ ID NO: 191163 - DNA, 3179 bp, Homo sapiens
  Payload ID: 17759
  Gene Name: thymocyte selection associated
  Uniprot ID: Q8N1K5
  ENST ID: ENST00000614155
  CDS Start-End: 185-2005
atacttacaattacgagatttatatttgcattagtctctttggctggtgggtaggggtgagaggctcttcctggatcccttattttctacaggagaggaggaaaacacctgggatgctccagtgctcttacgcagataatgatcattaacatcagcctctctgatcaaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattgagagtcataggagttttccataaccttctcttctatgacccaacaacaagctcatgactgaaatttcaccagatttctgagacgatgtcttaatattctatgtgctatgtaccagataattctttagatgaatgtttcttaggattgtaggaaaattatctagttaatcataatatttgatggaaagaaaaagacaataaaattgtaatataataaatttggctgacaagaaaccaaagtgattcttaattagtatacatcagaatgatgctcttatagttgtaccatctataaaaattactttaagggctctcacattttaataatttatcttattatgtattaagtatacaggaacaatattatttttcctttaacaaaatgaagagacaggctatctggttaatgttacataggaatttaatagtaatgcttgaacttcatccatagatcatactctgtacaaaatttgttagctaacatcctatctcataattattttatgttttgtggagaaatttgttgattttgtaccaaagtgtttctgaagacaataaattgtgagtcaacttt

SEQ ID NO: 191164 - DNA, 631 bp, Homo sapiens; identical to SEQ ID NO: 191159
  Payload ID: 17759
  Gene Name: thymocyte selection associated
  ENST ID: ENST00000626111
  CDS Start-End: 1-631

SEQ ID NO: 191165 - DNA, 3179 bp, Homo sapiens; identical to SEQ ID NO: 191163
  Payload ID: 17759
  Gene Name: thymocyte selection associated
  ENST ID: ENST00000626040
  CDS Start-End: 317-2005

SEQ ID NO: 191166 - DNA, 2786 bp, Homo sapiens
  Payload ID: 17759
  Gene Name: thymocyte selection associated
  Uniprot ID: Q8N1K5
  ENST ID: ENST00000630369
  CDS Start-End: 142-2184
caccccactctggctgtagtgtgacattcctgcctgcctgaggaagaaatggtgagcaggggctgcaattgcagacaagtgtcacccagaagccacaagtttctgtgagcaccaggtctacaaactacccaaggcatagcaatggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaaggctggagtgcaatggcgtgatcttggctcgctgcaacctctgcctcccgggttcaagcaattctctgcctcagcctcccacgtagctgggattacaggcaccccccaccacgtccagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataacaagatgtgacagaagccacttaggcagcaaacataaatgttgcagtgaaaaaagaagctagccttctagctgaaaaacgagtattccccaatggactccagaagaaacttgattcatcgctgcaaaggaaagaacaaccttaaaacttttaacagataaaacttacagaaacctatgatatagaattcatatagtctattctgttgtgtctaaatctgtaggcattgtgttgttgttctttaggacgtatttatttaacttgcacattttttcagattcttatttctactaccaacaactaagtaattgggaaataattctgtatttcagtttctgagtaaaaccagtctgaaataggataaaagccaccaaatattttcttttttttccagaatttgttttgccattttttagtgctatcatcattcctaacaagactaacttacagaaaaataattatatctgactgatttaaaatgttcaggtttcttatccaaatcccttggaactatggaaaggagtttgatttcacattcacagtgtatttacaaaatacgctgtgtcataaatatgtttgaattccaacagccaaagccattga

SEQ ID NO: 191167 - DNA, 2337 bp, Homo sapiens
  Payload ID: 17760
  Gene Name: thymocyte selection associated family member 2
  Uniprot ID: Q5TEJ8
  ENST ID: ENST00000328928
  CDS Start-End: 30-1574
cagtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaa

SEQ ID NO: 191168 - DNA, 2687 bp, Homo sapiens
  Payload ID: 17760
  Gene Name: thymocyte selection associated family member 2
  Uniprot ID: Q5TEJ8
  ENST ID: ENST00000373921
  CDS Start-End: 5-1936
gaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctc

SEQ ID NO: 191169 - DNA, 1650 bp, Homo sapiens
  Payload ID: 17760
  Gene Name: thymocyte selection associated family member 2
  Uniprot ID: Q5TEJ8
  ENST ID: ENST00000373925
  CDS Start-End: 29-811
agtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgagaa

SEQ ID NO: 191170 - DNA, 1082 bp, Homo sapiens
  Payload ID: 17760
  Gene Name: thymocyte selection associated family member 2
  Uniprot ID: Q5TEJ8
  ENST ID: ENST00000373927
  CDS Start-End: 24-395
gagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaat

SEQ ID NO: 191171 - DNA, 415 bp, Homo sapiens
  Payload ID: 17760
  Gene Name: thymocyte selection associated family member 2
  ENST ID: ENST00000427466
  CDS Start-End: 17-415
gagagccgcggggaccatggagccggtgccgctgcaggacttcgtgcgcgccttggaccccgcctccctcccgcgcgtgctgcgggtctgctcgggggtctacttcgagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccag

SEQ ID NO: 191172 - DNA, 1926 bp, Homo sapiens
  Payload ID: 17760
  Gene Name: thymocyte selection associated family member 2
  ENST ID: ENST00000456990
  CDS Start-End: 1-1175
ccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctc

SEQ ID NO: 191173 - DNA, 754 bp, Homo sapiens
  Payload ID: 17760
  Gene Name: thymocyte selection associated family member 2
  ENST ID: ENST00000442118
  CDS Start-End: 15-754
gagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatgg

SEQ ID NO: 191174 - DNA, 4131 bp, Homo sapiens
  Payload ID: 17761
  Gene Name: thymocyte selection-associated high mobility group box
  Uniprot ID: O94900
  ENST ID: ENST00000361421
  CDS Start-End: 222-1802
ggtgcgcgccgcggcttgggggagagttgagcgcttttcccccctcttttttttttttttcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtg

SEQ ID NO: 191175 - DNA, 820 bp, Homo sapiens
  Payload ID: 17762
  Gene Name: thymopoietin
  Uniprot ID: P42167
  ENST ID: ENST00000261210
  CDS Start-End: 17-763
ttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgatactaaaaa

SEQ ID NO: 191176 - DNA, 3615 bp, Homo sapiens
  Payload ID: 17762
  Gene Name: thymopoietin
  Uniprot ID: P42166
  ENST ID: ENST00000266732
  CDS Start-End: 239-2323
gggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtg

SEQ ID NO: 191177 - DNA, 2465 bp, Homo sapiens
  Payload ID: 17762
  Gene Name: thymopoietin
  ENST ID: ENST00000343315
  CDS Start-End: 251-1495
gtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaa

SEQ ID NO: 191178 - DNA, 2374 bp, Homo sapiens
  Payload ID: 17762
  Gene Name: thymopoietin
  Uniprot ID: P42167
  ENST ID: ENST00000393053
  CDS Start-End: 238-1275
ggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctacta

SEQ ID NO: 191179 - DNA, 4242 bp, Homo sapiens
  Payload ID: 17762
  Gene Name: thymopoietin
  Uniprot ID: P42167
  ENST ID: ENST00000556029
  CDS Start-End: 357-1721
cgcgagccgtctcgccaatcaccgccgcgcttcctcccgtcgcccgccaatggcggcgcgcgttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccaggcgcggtggcttacgcctgtaatcccagcactttgggaggccagggcgggtggatcacgaggtcaagagatcaagaccatcctggccaacatggtgaaaccccgtctctactaaaaatacaaaaaaattagctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacatcataagcagtagttaataaagttgtatactcttaagaggtgggcattatgattattttttatttttttattttttatgagatggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatg

SEQ ID NO: 191180 - DNA, 713 bp, Homo sapiens
  Payload ID: 17762
  Gene Name: thymopoietin
  ENST ID: ENST00000556678
  CDS Start-End: 1-713
aaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcaga

SEQ ID NO: 191181 - DNA, 496 bp, Homo sapiens
  Payload ID: 17763
  Gene Name: thymosin beta 10
  Uniprot ID: P63313
  ENST ID: ENST00000233143
  CDS Start-End: 110-244
atataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggc

SEQ ID NO: 191182 - DNA, 685 bp, Homo sapiens
  Payload ID: 17764
  Gene Name: thymosin beta 15a
  Uniprot ID: P0CG34
  ENST ID: ENST00000289373
  CDS Start-End: 137-274
ggcggggcctgctgggtggcttagcactgcagggctctgcgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatcttga

SEQ ID NO: 191183 - DNA, 665 bp, Homo sapiens
  Payload ID: 17765
  Gene Name: thymosin beta 15B
  Uniprot ID: P0CG35
  ENST ID: ENST00000540220
  CDS Start-End: 115-252
agcactgcagggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtctg

SEQ ID NO: 191184 - DNA, 2186 bp, Homo sapiens
  Payload ID: 17765
  Gene Name: thymosin beta 15B
  Uniprot ID: P0CG35
  ENST ID: ENST00000436583
  CDS Start-End: 1644-1781
gccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagtcctgggtctgatcctagttagctgtcccttcttacagcgtttacaaaccagtgccacaaggagctattatgagacgtgtattgtagtgccttaatgtactgtcgtctttggggatttaaaatagatagaaattaatacaacttatctcattctttttttgtgtgctgctccccatctcccaagaaaaatggcaaaaccaaaagtaaatagaaagtgaagatgctcaaatggtgctatgttctgtttcaaaataattacctggttaaaaccagtctttattttttcttctatccctgtctggtcttgtgcttctatcacctccattttatccttgctgtgattttaagagtcagacaaatggctctgtgtttctagagcatcttggtttctggtgcgttatgatccaatgacatttactgcctatcagaaacggcaaatgatgtggagttgaaattattctaacaaaaatataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgtt

SEQ ID NO: 191185 - DNA, 1666 bp, Homo sapiens
  Payload ID: 17765
  Gene Name: thymosin beta 15B
  Uniprot ID: P0CG35
  ENST ID: ENST00000419165
  CDS Start-End: 1118-1255
catagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctacccaagcagcctctggccctgaagctactgctagcaagactcgggagctggctggcgggggctgaggccgacaggcacgggagccggcgcggcgtcaagtggagctcggacgcacggaccaggcccatttccctttcatctacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtc

SEQ ID NO: 191186 - DNA, 663 bp, Homo sapiens
  Payload ID: 17765
  Gene Name: thymosin beta 15B
  Uniprot ID: P0CG35
  ENST ID: ENST00000569577
  CDS Start-End: 134-271
ctgggtctcagccccgcgtacggcctttcacgagtcttcaagccttcagcactttgggaggccgaggcgggcagatcacttgaggccaggagttccagaccagcctggccaacatggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataat

SEQ ID NO: 191187 - DNA, 590 bp, Homo sapiens
  Payload ID: 17765
  Gene Name: thymosin beta 15B
  ENST ID: ENST00000563257
  CDS Start-End: 101-238
ctgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaatctttttcagcttagtgggagttaacatccaagactgaagttggatggagaaaggggcaggaggcacttgctaccaaacaccatattaagcacatcacatcttctaatgacctgtagcactgaacttctggtacggtttttctactgaacagaatttgctgttttatgaactaaacatttctggtgttcatggtgagcataaatgttatggtctgaattttgtcacctgtgacctcctgattaatatgctgaagccctaatccctagcatgattgtatctggagataggttgtttcagaagtaatttacgttatgaagtgataacagtcagggcctaatctaataggactgtggccttataaggagagagagaccagtctctaacatgcg

SEQ ID NO: 191188 - DNA, 495 bp, Homo sapiens
  Payload ID: 17766
  Gene Name: thymosin beta 4, X-linked
  Uniprot ID: P62328
  ENST ID: ENST00000380633
  CDS Start-End: 91-225
ggcaagaccggcttcggggcgcgcggcggccgctttgtgtgcggggctgcattgtgacgcgggcgatgaagccgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaa

SEQ ID NO: 191189 - DNA, 767 bp, Homo sapiens
  Payload ID: 17766
  Gene Name: thymosin beta 4, X-linked
  Uniprot ID: P62328
  ENST ID: ENST00000380635
  CDS Start-End: 217-351
gtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaagcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 191190 - DNA, 1702 bp, Homo sapiens
  Payload ID: 17766
  Gene Name: thymosin beta 4, X-linked
  Uniprot ID: P62328
  ENST ID: ENST00000380636
  CDS Start-End: 1153-1287
aactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactt

SEQ ID NO: 191191 - DNA, 628 bp, Homo sapiens
  Payload ID: 17766
  Gene Name: thymosin beta 4, X-linked
  Uniprot ID: P62328
  ENST ID: ENST00000451311
  CDS Start-End: 78-212
acaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 191192 - DNA, 1669 bp, Homo sapiens
  Payload ID: 17767
  Gene Name: thymosin beta 4, Y-linked
  Uniprot ID: O14604
  ENST ID: ENST00000284856
  CDS Start-End: 770-904
tgggaacagacagatcctttgttctgaggctcactcatctcccgagccccgagccgtctcccagcctcagacggctctgcgggctgcatctgtgcagcctggcagcggcggcgctgcgctgtgacattttcacagcccttcttgcagaggcatgtgtgctagggatgccgaaatgccgagagcgccggcaggactagcttccgggccgcgctttgtgtgctgggctgcagtgtggcgcgggcgaggaagctggtagggcggttgtcgcaagctccagctgcagcctccgcctacgtgagaagactagaaagcgggcgcaggaccaggcctgcgttgtttgcagagaggccgtggctacaaaatggaagtgcttttgcgacctgggctccattttaggaattcttgcccgattttaaccacttgaacgcggaagtggctttcctattctcttccaagccagcctttaattttaaacgctgtaattaacagttcacaggggtcaaattcctttattccggaacattccactttgagagggatctgtcctctttggtcccctgcgttttcaaatatttgaggaaaggtgtcgcctctttttctgtggaaagaggaagctcatgagcgcgaaacagcaggggacggagggcgagaagggctttctcaggttgcgggtcggagggcagaagcacagttcccagtacagagacccggacaggtggctgtttctcacgctcactttggattgctccctacggcttcctccgcagccatgtctgacaaacctggtatggctgagatcgagaaattcgataagtcgaaactgaagaagacagaaacgcaagagaagaatccattgtcttccaaagaaactatcgaacaggagaggcaagcaggcgaatcttaaacaggcatgtgccaccaatatctactgtacattctacaagcattgctttcttattttacttcttttacttgtttaacttggttagatgcaaacacgttggatgagtttgaaaggactatgctgcccttttgacatcaaagacctgctgacaatggaggccacgcctgcttctcccatcgcctgtctggctggcagggaaggaaaatagcttgaatgttggtgaaagacttagcggagtgggagggcagtgaaatctagagtaaaaccaagttgggccaagtgtcctgcagaatctaaaatgaagtttaatcagcgtgccatttttgttgttgtttgaaagattttaatttttggaatgcacagtttttatttaaaaaagacatttttaaaccactgcttgtgagattgcttgttgattggaaagagtgttttattcaccatttaaacgtttgcaaagtggcgtgccccttggcctcacaggcaaagaataacttaaaagctgacgatttgaataaattatgttacagtatgaaatatgttttacctggatatgtaaaataccttctttattctagctaattgggagatgattttttttggctaattgagattacctttagattatgttttcaaaactggcttatactgtaatctacaactaataagcactaatttagagttcagctatattgttgcatgtagtgagaagggacttaattacaaacttaagacgtaagtgtgcaataaagtaagctaagaagaaaa

SEQ ID NO: 191193 - DNA, 1583 bp, Homo sapiens
  Payload ID: 17768
  Gene Name: thymus, brain and testes associated
  Uniprot ID: Q96M53
  ENST ID: ENST00000299290
  CDS Start-End: 391-1446
acaaagcaggcagacttgcccacagaacccacagccttcccctcgatttgtcctcttgctccttcctgctaggacagcagggcttctcgtacacatgctgtagcgggcactgccttggcaggaggatttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctggtcctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgag

SEQ ID NO: 191194 - DNA, 1586 bp, Homo sapiens
  Payload ID: 17768
  Gene Name: thymus, brain and testes associated
  ENST ID: ENST00000456372
  CDS Start-End: 391-1449
acaaagcaggcagacttgcccacagaacccacagccttcccctcgatttgtcctcttgctccttcctgctaggacagcagggcttctcgtacacatgctgtagcgggcactgccttggcaggaggatttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagcagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctggtcctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgag

SEQ ID NO: 191195 - DNA, 8450 bp, Homo sapiens
  Payload ID: 17769
  Gene Name: thyroglobulin
  Uniprot ID: P01266
  ENST ID: ENST00000220616
  CDS Start-End: 41-8347
cagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttccttccagaggaggttccctgaggtatctgggtattgccactgtgctgacagccaagggcgggaactggctgagacaggtttggagttgttactggatgaaatttatgacaccatttttgctggcctggaccttccttccaccttcactgaaaccaccctgtaccggatactgcagagacggttcctcgcagttcaatcagtcatctctggcagattccgatgccccacaaaatgtgaagtggagcggtttacagcaaccagctttggtcacccctatgttccaagctgccgccgaaatggcgactatcaggcggtgcagtgccagacggaagggccctgctggtgtgtggacgcccaggggaaggaaatgcatggaacccggcagcaaggggagccgccatcttgtgctgaaggccaatcttgtgcctccgaaaggcagcaggccttgtccagactctactttgggacctcaggctacttcagccagcacgacctgttctcttccccagagaaaagatgggcctctccaagagtagccagatttgccacatcctgcccacccacgatcaaggagctctttgtggactctgggcttctccgcccaatggtggagggacagagccaacagttttctgtctcagaaaatcttctcaaagaagccatccgagcaatttttccctcccgagggctggctcgtcttgcccttcagtttaccaccaacccaaagagactccagcaaaacctttttggagggaaatttttggtgaatgttggccagtttaacttgtctggagcccttggcacaagaggcacatttaacttcagtcaatttttccagcaacttggtcttgcaagcttcttgaatggagggagacaagaagatttggccaagccactctctgtgggattagattcaaattcttccacaggaacccctgaagctgctaagaaggatggtactatgaataagccaactgtgggcagctttggctttgaaattaacctacaagagaaccaaaatgccctcaaattccttgcttctctcctggagcttccagaattccttctcttcttgcaacatgctatctctgtgccagaagatgtggcaagagatttaggtgatgtgatggaaacggtactcagctcccagacctgtgagcagacacctgaaaggctatttgtcccatcatgcacgacagaaggaagctatgaggatgtccaatgcttttccggagagtgctggtgtgtgaattcctggggcaaagagcttccaggctcaagagtcagaggtggacagccaaggtgccccacagactgtgaaaagcaaagggctcgcatgcaaagcctcatgggcagccagcctgctggctccaccttgtttgtccctgcttgtactagtgagggacatttcctgcctgtccagtgcttcaactcagagtgctactgtgttgatgctgagggtcaggccattcctggaactcgaagtgcaatagggaagcccaagaaatgccccacgccctgtcaattacagtctgagcaagctttcctcaggacggtgcaggccctgctctctaactccagcatgctacccaccctttccgacacctacatcccacagtgcagcaccgatgggcagtggagacaagtgcaatgcaatgggcctcctgagcaggtcttcgagttgtaccaacgatgggaggctcagaacaagggccaggatctgacgcctgccaagctgctagtgaagatcatgagctacagagaagcagcttccggaaacttcagtctctttattcaaagtctgtatgaggctggccagcaagatgtcttcccggtgctgtcacaatacccttctctgcaagatgtcccactagcagcactggaagggaaacggccccagcccagggagaatatcctcctggagccctacctcttctggcagatcttaaatggccaactcagccaatacccggggtcctactcagacttcagcactcctttggcacattttgatcttcggaactgctggtgtgtggatgaggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtgcccaagcctctgcaatgtgctcaagagtggagtcctctccaggagagtcagcccaggctatgtcccagcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtg

SEQ ID NO: 191196 - DNA, 745 bp, Homo sapiens
  Payload ID: 17769
  Gene Name: thyroglobulin
  ENST ID: ENST00000523901
  CDS Start-End: 44-223
aagcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagtaaggcttatgtcagcagcgaactctcaaggactgtccagtgccagaacgacggccgctcctgctggtgtgtgggtgccaacggcagtgaagtgctgggcagcaggcagccaggacggcctgtggcttgtctgtcattttgtcagctacagaaacagcagatcttactgagtggctacattaacagcacagacacctcctacctccctcagtgtcaggattcaggggactacgcgcctgttcagtgtgatgtgcagcaggtccagtgctggtgtgtggacgcagaggggatggaggtgtatgggacccgccagctggggaggccaaagcgatgtccaaggagctgtgaaataagaaatcgtcgtcttctccacggggtgggagataagtcaccaccccagtgttctgcggagggagagtttatgcctgtccagtgcaaatttgtcaacaccacagacatgatgatttttgatctggtccacagctacaacaggtttccagatgcatttgtgaccttcagttcctt

SEQ ID NO: 191197 - DNA, 5065 bp, Homo sapiens
  Payload ID: 17769
  Gene Name: thyroglobulin
  ENST ID: ENST00000523756
  CDS Start-End: 1-442
ctcggctggagcatccgcccttctgcggtcgggcccctacatgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaacggccccagctgtggcagaccatccagacccaagggcactttcagctccagctcccgccgggcaagatgtgcagtgctgactacgcggatttgctgcagactttccaggttttcatattggatgagctgacagcccgcggcttctgccagatccaggtgaagacttttggcaccctggtttccattcctgtctgcaacaactcctctgtgcaggtgggttgtctgaccagggagcgtttaggagtgaatgttacatggaaatcacggcttgaggacatcccagtggcttctcttcctgacttacatgacattgagagagccttggtgggcaaggatctccttgggcgcttcacagatctgatccagagtggctcattccagcttcatctggactccaagacgttcccagcggaaaccatccgcttcctccaaggggaccactttggcacctctcccaggacatggtttgggtgctcggaaggattctaccaagtcttgacaagtgaggccagtcaggacggactgggatgcgttaagtgtcctgaaggaagctattcccaagatgaggaatgcattccttgtcctgttggattctaccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggccaaggatccaccacaacacttcagaaacgctttgaacccactggtttccaaaacatgctttctggattgtacaaccccattgtgttctcagcctcaggagccaatctaaccgatgctcacctcttctgtcttcttgcatgcgaccgtgatctgtgttgcgatggcttcgtcctcacacaggttcaaggaggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtg

SEQ ID NO: 191198 - DNA, 185 bp, Homo sapiens
  Payload ID: 17769
  Gene Name: thyroglobulin
  ENST ID: ENST00000518058
  CDS Start-End: 1-185
attctgacatggggtctcggcctgagtctatgggatgtagaaaagacacagtgccaaggccagcatctccaacagaagcaggttgtgtgcaggagcactctttctgtcagctcgcagagataacagagagtgcatccttgtacttcacctgcaccctctacccagaggcacaggtgtgtgatgac

SEQ ID NO: 191199 - DNA, 678 bp, Homo sapiens
  Payload ID: 17769
  Gene Name: thyroglobulin
  ENST ID: ENST00000518505
  CDS Start-End: 1-678
ttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcctagaaacaggagagtatgccaggctgcaggcatcgggggctggcacctggtgtgtggaccctgcatcaggagaagagttgcggcctggctcgagcagcagtgcccagtcctgcagggcagaggatgggggcttttccccagtgcaatgtgaccaggcccagggcagctgctggtgtgtcatggacagcggagaagaggtgcctgggacgcgcgtgaccgggggccagcccgcctgtgagagcccgcggtgtccgctgccattcaacgcgtcggaggtggttggtggaacaatcctgtgtgagacaatctcgggccccacaggctctgccatgcagcagtgccaattgctgtgccgccagggctcctggagcgtgtttccaccagggccattgatatgtagcctggagagcggacgctgggagtcacagctgcctcagccccgggcctgccaac

SEQ ID NO: 191200 - DNA, 581 bp, Homo sapiens
  Payload ID: 17769
  Gene Name: thyroglobulin
  ENST ID: ENST00000518108
  CDS Start-End: 1-581
acattcagaatgccagtggagagagcactcactgaggcctctccccttcctcacccctttctcttccctttcccaacaggaatctctctgctcagctatgaggcatctgtaccttctgtgcccatttccacccatggccggctgctgggcaggtcccaggccatccagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacgg

SEQ ID NO: 191201 - DNA, 481 bp, Homo sapiens
  Payload ID: 17769
  Gene Name: thyroglobulin
  ENST ID: ENST00000522797
  CDS Start-End: 1-223
gggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtttaaagtccgggaggtgagagggacccagctgaagaggatggagtgagggcttccgtataactggagtacctggtgtcatgggaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactc

SEQ ID NO: 191202 - DNA, 616 bp, Homo sapiens
  Payload ID: 17769
  Gene Name: thyroglobulin
  ENST ID: ENST00000521107
  CDS Start-End: 1-519
tcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacat

SEQ ID NO: 191203 - DNA, 3132 bp, Homo sapiens
  Payload ID: 17769
  Gene Name: thyroglobulin
  ENST ID: ENST00000519543
  CDS Start-End: 318-3023
attgcttttaaggagggcacatagttttaagagaaataggaaatggcttaatctaatacggcacgtaaaccaggtataagatgaagtggctacagtattcattctttcatccaaccagacatttttgagcacatgtggctgtggccttggacattcacaggctagtgagaattccatgtgccagccactgcatgacagtgtggcaagggatgcaatgtggacaggtgtcggttgcagtgagaatgcaggagaaggaatgctagcagcctgcaggggccaggaaaggtttctcggaggaggccagaaggatctgccagatgctcccaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccatgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccgaggctgcccactatggtcatctttttctctaaaatagccacttaccttcaataaagtatctacatgcggtgaagcat

SEQ ID NO: 191204 - DNA, 3706 bp, Homo sapiens
  Payload ID: 17769
  Gene Name: thyroglobulin
  ENST ID: ENST00000519178
  CDS Start-End: 1-3673
ccaagaacaggcagggagcttggcctgtgtcccatgtcctgtgggcagaacgaccatttctgctggagctttcagccagactcactgtgtcactgactgtcagaggaacgaagcaggcctgcaatgtgaccagaatggccagtatcgagccagccagaaggacaggggcagtgggaaggccttctgtgtggacggcgaggggcggaggctgccatggtgggaaacagaggcccctcttgaggactcacagtgtttgatgatgcagaagtttgagaaggttccagaatcaaaggtgatcttcgacgccaatgctcctgtggctgtcagatccaaagttcctgattctgagttccccgtgatgcagtgcttgacagattgcacagaggacgaggcctgcagcttcttcaccgtgtccacgacggagccagagatttcctgtgatttctatgcttggacaagtgacaatgttgcctgcatgacttctgaccagaaacgagatgcactggggaactcaaaggccaccagctttggaagtcttcgctgccaggtgaaagtgaggagccatggtcaagattctccagctgtgtatttgaaaaagggtgccatcatctgtgggttgctgagctcacccagtgtcctgctttgtaatgtcaaagactggatggatccctctgaagcctgggctaatgctacatgtcctggtgtgacatatgaccaggagagccaccaggtgatattgcgtcttggagaccaggagttcatcaagagtctgacacccttagaaggaactcaagacacctttaccaattttcagcaggtttatctctggaaagattctgacatggggtctcggcctgagtctatgggatgtagaaaagacacagtgccaaggccagcatctccaacagaagcaggtttgacaacagaacttttctcccctgtggacctcaaccaggtcattgtcaatggaaatcaatcactatccagccagaagcactggcttttcaagcacctgttttcagcccagcaggcaaacctatggtgcctttctcgttgtgtgcaggagcactctttctgtcagctcgcagagataacagagagtgcatccttgtacttcacctgcaccctctacccagaggcacaggtgtgtgatgacatcatggagtccaatgcccagggctgcagactgatcctgcctcagatgccaaaggccctgttccggaagaaagttatactggaagataaagtgaagaacttttacactcgcctgccgttccaaaaactgatggggatatccattagaaataaagtgcccatgtctgaaaaatctatttctaatgggttctttgaatgtgaacgacggtgcgatgcggacccatgctgcactggctttggatttctaaatgtttcccagttaaaaggaggagaggtgacatgtctcactctgaacagcttgggaattcagatgtgcagtgaggagaatggaggagcctggcgcattttggactgtggctctcctgacattgaagtccacacctatcccttcggatggtaccagaagcccattgctcaaaataatgctcccagtttttgccctttggttgttctgccttccctcacagagaaagtgtctctggactcgtggcagtccctggccctctcttcagtggttgttgatccatccattaggcactttgatgttgcccatgtcagcactgctgccaccagcaatttctctgctgtccgagacctctgtttgtcggaatgttcccaacatgaggcctgtctcatcaccactctgcaaacccaacctggggctgtgagatgtatgttctatgctgatactcaaagctgcacacatagtctgcagggtcagaactgccgacttctgcttcgtgaagaggccacccacatctaccggaagccaggaatctctctgctcagctatgaggcatctgtaccttctgtgcccatttccacccatggccggctgctgggcaggtcccaggccatccaggtgggtacctcatggaagcaagtggaccagttccttggagttccatatgctgccccgcccctggcagagaggcgcttccaggcaccagagcccttgaactggacaggctcctgggatgccagcaagccaagggccagctgctggcagccaggcaccagaacatccacgtctcctggagtcagtgaagattgtttgtatctcaatgtgttcatccctcagaatgtggcccctaacgcgtctgtgctggtgttcttccacaacaccatggacagggaggagagtgaaggatggccggctatcgacggctccttcttggctgctgttggcaacctcatcgtggtcactgccagctaccgagtgggtgtcttcggcttcctgagttctgggtccggagaggtgagtggcaactgggggctgctggaccaggtggcggctctgacctgggtgcagacccacatccgaggatttggcggggaccctcggcgcgtgtccctggcagcagaccgtggcggggctgatgtggccagcatccaccttctcacggccagggccaccaactcccaacttttccggagagctgtgctgatgggaggctccgcactctccccggccgccgtcatcagccatgagagggctcagcagcaggcaattgctttggcaaaggaggtcagttgccccatgtcatccagccaagaagtggtgtcctgcctccgccagaagcctgccaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggccagtgcctgggcaaagagggcccgaggaaacgtcttcatgtaccatgctcctgaaaactacggccatggcagcctggagctgctggcggatgttcagtttgccttggggcttcccttctacccagcctacgaggggcagttttctctggaggagaagagcctgtcgctgaaaatcatgcagtacttttcccacttcatcagatcaggaaatcccaactacccttatgagttctcacggaaagtacccacatttgcaaccccctggcctgactttgtaccccgtgctggtggagagaactacaaggagttcagtgagctgctccccaatcgacagggcctgaagaaagccgactgctccttctggtccaagtacatctcgtctctgaagacatctgcagatggagccaagggcgggcagtcagcagagagtgaagaggaggagttgacggctggatctgggctaagagaagatctcctaagcctccaggaaccaggctctaagacctacagcaagtgaccagcccttgagctccccaaaaacctcacccga

SEQ ID NO: 191205 - DNA, 5900 bp, Homo sapiens
  Payload ID: 17770
  Gene Name: thyroid adenoma associated
  ENST ID: ENST00000398653
  CDS Start-End: 133-1026
agtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcatgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccc

SEQ ID NO: 191206 - DNA, 5585 bp, Homo sapiens
  Payload ID: 17770
  Gene Name: thyroid adenoma associated
  ENST ID: ENST00000408045
  CDS Start-End: 133-1026
agtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggtatgttaaaatcccacatgagcaaggagttatcaggggttaggaatacatttgagaattgctgtttctagttgtggggagttttaaaagtcattggcatgagttttctaaacttattggagtatttatccttttagaactttgggttgtggtaaagaaagaaaaatattttcttgacaatttttctaaaactgctaagtgactgaggggcatgtaatatggctttttgtctgcccaccaatcagcttgtttttgttgaaacctgctgcgtgcccagtcctgtgttagatattataacaatgaaaggcagtaattgactaaatcatgtggtacagactcttaggtgccgtggcaactcagagattagagattgctgtaggcttgagcaggcactgagggacagatagggtgtgaatagcaagaggggatggaagttgcctttcttaggtgggtagtaaggtagcttgaataagcaaggcaaaaaagaatagaaacatatttttcatccttgccattgttagtttatcctggaacttagaacatttactgtgtgaaagatgaaggagtaaaaggaatttctcatgtaatatacagggagtcctctctgtaatgccatgttcaaaatctgtgttgcaggactctggtggtggtaggatagtgttaactgcaaaggccctccgtaggtcctctgtaagttccaccagagtagctccagaagaggcgcatgtgttagtgttactacctttcctgccatagtacacgcatttaattaagagtcagtttattggccgggtgtggtggttcatgtctgtaatcccagcactttgggaggctagggcagaaggattgcttgagcccaggagttcaagaacagcctggacaacataacgagaccccatctctacaaaacaacgacaacaacaaaaattagccaggtatggtggtgcatgcctgtagtcccaactacttgggaggctaaggcaggaggatggtttgggcccaggagtttaaggctctagtgagctgtgattgcaccactgcactccagactgggtgacagagtgagaccttgtttcaaaaataaataaatttctgatgcttagagtttgagaaacaaacaa

SEQ ID NO: 191207 - DNA, 3043 bp, Homo sapiens
  Payload ID: 17770
  Gene Name: thyroid adenoma associated
  Uniprot ID: Q6YHU6
  ENST ID: ENST00000404790
  CDS Start-End: 118-2802
gcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatgggtttgtattgatgtttgctcttatcaaaacgaatagcttagtctcagtattcatttggttagaatatctaatggttaaacatatattttgtggttttttatttaaaagtttatcagcatataagagcaccatgggttctcattatgcaaatgaacattttagtcagctataatacttttttctaaacagtggatttatgttgaataagtacatatacaaatatttattaataaagctcttttgaaatgagaa

SEQ ID NO: 191208 - DNA, 2749 bp, Homo sapiens
  Payload ID: 17770
  Gene Name: thyroid adenoma associated
  ENST ID: ENST00000402796
  CDS Start-End: 1-1227
cttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcagttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagag

SEQ ID NO: 191209 - DNA, 2974 bp, Homo sapiens
  Payload ID: 17770
  Gene Name: thyroid adenoma associated
  Uniprot ID: Q6YHU6
  ENST ID: ENST00000402360
  CDS Start-End: 29-2842
gcagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaagtaaggatttccacagctgcctcctgtctcagaaatccattcatttctgagctttaacctctggttggaatgtgtcctgggaaaggaatgcagtctattgctttgaataaaattgaaaatcagatttaaaaacata

SEQ ID NO: 191210 - DNA, 6939 bp, Homo sapiens
  Payload ID: 17770
  Gene Name: thyroid adenoma associated
  ENST ID: ENST00000403856
  CDS Start-End: 149-2761
agacgccgtagaaggagacctgcttccgggactggaccaggcgcctgcgactcttctcagacgccgacgtgcacgagaaatcaggacacggtagtacctcctcttagtctaatgagtcactgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggtaagtgtttaataatgttaggggaagtaatttttgttttctttcaaaacatacttattctacattttgctttatttgaagtttcagttttgttgcctttctttgaggtttcattcttaccttataattcttgcttgtacataatgaaatttgctagtaaaggacagaagaggaagaaactatctcccttttcattgatcattatttgccaaccccaaagtataattttcatggattatgcttattatggaaagagttccagctattacctcactaatttgtttgttgctgttttaagatagtatccaatctgttctttaagttttaaaatttgaaataataatagcttctattatatttaatatttctcagtgagtctctgtggttaaaatgtggtttcctttacatgccgtctgtttcatgtgcctcagtctggtttcggaaagacaatatgaggatgtaatttccaagtattctgatttaataataccctttgtttttccttctgtgtggttctcaagagggtcaaatttcagttccctctttgaatcttttttttttgtttcattttttcctttttgacaagaaatgattcctttttttttattttgagacagagtctagctctgttgcccaggctggagtgtggtggcgtgatctcggctcactgcaacctccgcctgctgggttcaagcgattctcctgcctcagcctcccgagtagctgggacttcaggcgcatgccgctacacctggctaattttttgtatttttagtagagatggggtttcaccatgttaagtcaggatggtctcgatctcctgacctcgtgatctgcccgcctcggcctcccaaagtggtgagattacaggcgtgagccaccgtgtcctgctgaaatgattcttttttccctgtatatgtgtgtatatgtgttagaatgtgggatttcttgcttgtgctgtcttcgttgactgtggtcaaacaggaaaatatcctgctcagctgctccttcacagggaatggccaaagcatgagggagctttacactatcattggattcttttttattttaaattattgggcaaagtgtaattttttgacaggaggacagttagctaatgtaaaagaggcttgcttcatttggggaaaatcagtttttaaaagtttttattctgaaaaaatttaaatcagcagcaaagtttcaagactggttcaatgaatagctatttatgctctacctagattcatcttttttttttttttttttgagacggagtctcgctctgttgcccaggctggggtacagtggcatgatcaccgtgacctctgcctcctgggttcaagcagttctcctgtctcagcctcctgagtagctgggattacaggcacgtgccaccacgcccaggttaatttttgtatttttagtagagacggggtttcaccatgttggtcaggctggtctcgaactcctgacctcaggttgtccgccttgcttagtctcccaaagtgctgggattacaggtgtgagccaccgcacctggccaattcatcagttattaatattttgcaatatttgctatatctgtgtcctttattaattctataaccataacacaatgatcaaattcaggaaattgaatgttgatacaatgctttaattgaatacgcaatccatatttaaattttgccaattgtcccaacaaatggccttttatattatagaacaaaaagcttcctacaatctgggaagcaatcctagatcacgcattgcgttttgttattatgcctctttttagcttcctttaatctggaaagtttctaattttatgatattaacattttggaagaatatgtctcagggtttgtctcattgtttcctgatgatttgattcatgctgtacatttttgcaggaatgttgcataggtgataatggtgttcttcacagggcatcctattagagtattgatgatactggcttgttccagtttttataataggaaatatgatcaccttattcacgtggggatggcaggctgaaaaatggtctctaaaacacatccacatcaaatctttagaagctgtgaatgcaaaccttacatggaagaagggtccttgcagatattcttaagtttaggatcttgaggtgagataattctagattatcttgatggatcaaaaatgtcatcacaagtatccttacaagacagaggcagagagagatttgacaaacaaaagaaagaggaggcagtgcgacagcgtaggtagagattggcatgagatggctacaggccatggaatgcctgcagctgctagaagctggaagaggcaaggaacagattttagagcctctggagtgcatggccctactgacaccttgattttgaacttctggcttccagaactatgagagaataggtttctgtggttttaagcaccaagtatgtggtaatttgttacagcatccagtgaatgcgggagtctcccatcagttcatagaatttcaatagtacttcaacttaatttagaaaataagtttttaccttagagtgattgattacttcaaccatataacaaaaagttttctgcacatttaaagcagttgtagctgcatctaagtgtgtgggaaataaaactaggctgaagcgtacctataatttttcagtcaagagagtaatttaatacatttaaatgtactttaaaaatgaaaaccctgagtcatctttctaatgaatgagttgcatgtaattgggcagtgacttaatgccatcgtaattatgttagacaactgggaggtaatgcaaatggagcaagccatactgcaggcattacttttaaaggaggcttaagaaccttgactatgaagtacaggatgggagatgtaaattcatccttcattatcatctcaagaacttcagtggtaggactgatttgagattagtcaaatggtttctgcctttcctagaccaggaagaataagttgcatgcatctttcttatgtggaatcaaatgccacaatattgatggtaaaaaaaaatctacaattagattaaaaggatttgttcagcaaatattaatttcgtgcttattatatgtcaagcagccgaggatattcacagtcccaaacaaggtgcttcttcctttggagcttatgtttcagtgaagggagatagtaatgaacaagtaatacatagaatttgtgtatattagtacattatgtagatacaagattatgtagattatttatgtacaagatgtagataagttctgtgaaaagtatttcaagaagataagggggatatatagaagacctaggaggctggagagtgttagtggcttcatacagtggtgtcataaagggcttcacatttgaaaaaagctcttaaacaactgatggataaaagaataaatcatgaaggaagttagaaaatattttgagatgaatgaaagcaaaaatacaacgtacgaaaacttatgcattgcagcaaaagctgtgcttatagggaaagttatagctgtaaatgcctacattaaaagatcttgaattaataaccaagttaactttccacctcaagcaattagaagagaagaacaaacttaaaaggaaggaaacaaaaagattagaacagagataaatgaaatagaaaacagaaaaacaacacgaataatctacgaaaccagaagttgtgttttttaaagattaacaaatagacaaagtttgctaaactgactaagataaaagaaagacagtataaacaactaaaatcagaaatgaaagtaggaacatttctattaagtttgcagaaataaaaatgattataagacagtacagtgaacaattgtaacaccaacaagttagataacctacatgaaatggacaagtttctagaaacatgacaattagtgacttgagaagaaatagaaaatgtgagcagacctataagagattgaatcagtattcaaaaggctcacagaggaagagaaggttcagggcaagtgacttctctggtgaaatctacaaagcatttaaagaagaattacaccagtccttctgagactctttcaaaaaattggagagaagggaacacctcctacctcattttataaggccatgattaccccgataccaaaaccaaagacacttaaaagaaaaccagccgggtgtggtggctcatgcctgtaatcccaccactttgggaggccgagtcaggtggatcacctgagatcaggagtttaagaccagactggccaacatggtgaaaccccgtcgctactaaaaatacaaaaaattagccgggcgtggtggcaggtacctgtaatcccagctactcaggaggctgaggcaggagaattgcctgaacccaggaggctgaggtttcaatgggctgagattgcgccattgtactccagcctgggcgacaagagcaagacttcatcaaagaaaagagaagaaaacagaggagaagagaaggaaaagaagaaa

SEQ ID NO: 191211 - DNA, 6310 bp, Homo sapiens
  Payload ID: 17770
  Gene Name: thyroid adenoma associated
  Uniprot ID: Q6YHU6
  ENST ID: ENST00000405006
  CDS Start-End: 353-6214
ggaccaggcgcctgcgactcttctcagacgccgacgtgcacgaggtttggctcccaggtgtcctgcctgccagacccgcggtagctcggctcggccagttttgctagggctgcctggcgagccacaccaattcccatcctttggtatcgccaggattcggcggctgtgaaactgatttccggtcgctaaggtctccatggagacagcactttaaccactttctcccactgtcattcctcgactccacgtggttcagaaatcgcccagagaatgtttgtgggagtcagccaggaaggtgtagagtgaagcagcgttctaaagggaagcatgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccc

SEQ ID NO: 191212 - DNA, 6114 bp, Homo sapiens
  Payload ID: 17770
  Gene Name: thyroid adenoma associated
  Uniprot ID: Q6YHU6
  ENST ID: ENST00000405975
  CDS Start-End: 141-6002
gacccggtagtcgaccgtggaccgcgctgcgagcctcggagacgccgtagaaggagacctgcttccgggactggaccaggcgcctgcgactcttctcagacgccgacgtgcacgagtgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctccccta

SEQ ID NO: 191213 - DNA, 3678 bp, Homo sapiens
  Payload ID: 17770
  Gene Name: thyroid adenoma associated
  ENST ID: ENST00000407351
  CDS Start-End: 1-3581
aaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatccca

SEQ ID NO: 191214 - DNA, 1975 bp, Homo sapiens
  Payload ID: 17770
  Gene Name: thyroid adenoma associated
  ENST ID: ENST00000474159
  CDS Start-End: 25-1071
tgactactattaattctatttaaaatgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacaggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggtaaaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacatta

SEQ ID NO: 191215 - DNA, 4432 bp, Homo sapiens
  Payload ID: 17771
  Gene Name: thyroid hormone receptor associated protein 3
  Uniprot ID: Q9Y2W1
  ENST ID: ENST00000354618
  CDS Start-End: 225-3092
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 191216 - DNA, 380 bp, Homo sapiens
  Payload ID: 17771
  Gene Name: thyroid hormone receptor associated protein 3
  ENST ID: ENST00000478853
  CDS Start-End: 260-380
tgtggggcgggggcgaggttcgggctggttgttccgttgcgagctgcagctgcgatctctgtggtaggcccaggtcaagagtcttcatctccagctgcctcagttttcttatcactaaaacagcaaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaa

SEQ ID NO: 191217 - DNA, 3339 bp, Homo sapiens
  Payload ID: 17771
  Gene Name: thyroid hormone receptor associated protein 3
  Uniprot ID: Q9Y2W1
  ENST ID: ENST00000469141
  CDS Start-End: 341-3208
ctgtggggcgggggcgaggttcgggctggttgttccgttgcgagctgcagctgcgatctctgtggtaggcccagcctggtggccaaaaacgggatagtccaaatttgtctcctacgggaatattagagttctcacttttttcttgggctggagctgaggccggcttgcattccagtggcaatcggcgtgagttctgcttatatgagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattg

SEQ ID NO: 191218 - DNA, 2153 bp, Homo sapiens
  Payload ID: 17772
  Gene Name: thyroid hormone receptor interactor 10
  Uniprot ID: Q15642
  ENST ID: ENST00000313244
  CDS Start-End: 36-1841
gcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtgggacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcgg

SEQ ID NO: 191219 - DNA, 2035 bp, Homo sapiens
  Payload ID: 17772
  Gene Name: thyroid hormone receptor interactor 10
  Uniprot ID: Q15642
  ENST ID: ENST00000313285
  CDS Start-End: 83-1720
gagtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgt

SEQ ID NO: 191220 - DNA, 1920 bp, Homo sapiens
  Payload ID: 17772
  Gene Name: thyroid hormone receptor interactor 10
  ENST ID: ENST00000596758
  CDS Start-End: 1-1782
atggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccatt

SEQ ID NO: 191221 - DNA, 586 bp, Homo sapiens
  Payload ID: 17772
  Gene Name: thyroid hormone receptor interactor 10
  ENST ID: ENST00000596673
  CDS Start-End: 336-586
gccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcgattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggc

SEQ ID NO: 191222 - DNA, 2249 bp, Homo sapiens
  Payload ID: 17772
  Gene Name: thyroid hormone receptor interactor 10
  ENST ID: ENST00000600428
  CDS Start-End: 647-1960
aatgcagcgggagcagacaagggccacaaagcattaaataaactacctttcccagtatccccaaggacggacttcctcttcttgagccagggatgtggctcccagccagagctgaggcttttggtaaacacacgcatctgttcaggcctgacctgttttcctaatcttcctggtccacagagaggcctaaagctggcctcaggttaaagtttgaccctaggatgacctatgaccccaggctgagaccccagccttaggctaagccttttattccagagtgaggcaattggagccccacccccagattccaggctagaccggactccgggctgaactctgaccccaggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaa

SEQ ID NO: 191223 - DNA, 2022 bp, Homo sapiens
  Payload ID: 17772
  Gene Name: thyroid hormone receptor interactor 10
  ENST ID: ENST00000600677
  CDS Start-End: 49-1080
gcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagccttcgaggcagccgtgggccctctacccaccttgcagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaa

SEQ ID NO: 191224 - DNA, 9996 bp, Homo sapiens
  Payload ID: 17773
  Gene Name: thyroid hormone receptor interactor 11
  Uniprot ID: Q15643
  ENST ID: ENST00000267622
  CDS Start-End: 375-6314
gatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgaccaaaacaacttgtccgcctctcatcccatggtttaacgtaagtttaaaagctgttgtgggtggattgcatagctaaacatcacagagcatgatattaaatggctgctatttaaataaatatgtgaccttgtcctaaagctataatactggccgggcacagtggctcacgcctgtaatcccagaactttgggagggtgaggtgggtggatcacctgaggtcaggagttcaagaccagcctggccaacatggtgaaaccccatctctactaaaaatacaaaaattagctgggcatggtggcaggcgcctataatcccagctactcaggaggctgaggcaggagaattgcttgaccccgggaagtggaggttgcagttagcaaccactccactgcactccagcctgagcgacagagcgagactctgtctcaaaaaaaaaaaaaaaaaaaaaaaagctatagtacctaatgttttcattgtgtcattgaaactatagctgactggtatgtatactaagtgttcgttgatctaaaccagatataagtcattgacttttctgaaacttagttgtgtcagagatgaaccacctgctcactgaaccgtcttagtaaccagtgatgaagcatataattctaatgttggcaataggacattgctaacagtgcgtttaactgcaatattttaactacagtaatttttctgtttatttctctatccactcagtagaatttgtggttgaattccaccttcgctgccatagttttttaccacattcctaatggttttcaacctctatactgtagtagaaaattcatctaactactgaatttaattttagcataatactggatcaaattgtttgaattttcattcctgtcatttttgatttttaaaaaatgaaacaaaactaaacaacaaaaccctaggaaaagaatggcttctttccaactagtcaattaaaacgtccagtatctccccaaataaagccttaggtttcttttaacctcttaatggttaattgaaaagagtacagaaactatcaaaatacttatccaatcaatggggggaaaagctatgtcttcagggacagtagagtgatgagaattttttagaaaacactattatccatcaaacttaaaagcatttggacctgatatttaaagataatgaagttttccacatattgaagtattcaagacatcttccatccacaaaaatttatctttaagttttgtaaatatcaagtaagtatagatgatatttattttatatattcctatggaaaaaatgctactttaatgttctgacatttgtgattatttgccagtctttactttttaacttattaaaaagttaaatacttattaaggtttctctatgtaaaacaatttaaattgtcttttgatttttagggaaatatctaaacgtgggaaatttccaacgcaaccttaatattaggttgtgttatttatagagctaaagttaatgcatttttgaatttctcaggagcactgcaaggcaaaaaaatactccaaataaaaatgatatatgtaagttggcaatgtcttcagtcacaataaaaaaaatttttagcaaaca

SEQ ID NO: 191225 - DNA, 5246 bp, Homo sapiens
  Payload ID: 17773
  Gene Name: thyroid hormone receptor interactor 11
  ENST ID: ENST00000554357
  CDS Start-End: 1-5086
agaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaac

SEQ ID NO: 191226 - DNA, 828 bp, Homo sapiens
  Payload ID: 17773
  Gene Name: thyroid hormone receptor interactor 11
  ENST ID: ENST00000557017
  CDS Start-End: 1-531
cgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatatcatcaagaaagtgagatgacaactcacagaatggggaaaacatgtttgtaaatcatatctgataacggaacttgtatccagctactactaggaaaatgcagcataattcaaaggaaaagatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcag

SEQ ID NO: 191227 - DNA, 564 bp, Homo sapiens
  Payload ID: 17773
  Gene Name: thyroid hormone receptor interactor 11
  ENST ID: ENST00000555516
  CDS Start-End: 362-564
ggaaggaagcaagcaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaat

SEQ ID NO: 191228 - DNA, 9874 bp, Homo sapiens
  Payload ID: 17774
  Gene Name: thyroid hormone receptor interactor 12
  Uniprot ID: Q14669
  ENST ID: ENST00000283943
  CDS Start-End: 180-6158
gctgcggctcagctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaaactcagtggcttgtttgacatagattgctgtgtcaatttacacttaaatggccttatatggaaatgtcccctcctgagagttcacttgggcagtgaccccattaagtggaagggaactgtcagaggagttgggggcagagaattctctccctgtctctgcagagactgacaagtgaatggcttttccctgaaatccaagaagggaattgtgtttctgcagttttcaccactaacagcacagttgctgagcagcttcatcaagtgaagttaaagactgaaacaatttgttttcaactgttctgatatcttcctgcaaattaagcacaaggatttttgtgtgaacatagcattttgttcctgatttttaaagggttctgttaaaatttagacatgtataaacaaaataatgtttcatctgtacttgacattttatccatgttgcagccctggcaaatttggcctcattgattccagcatctaataagtatatatgatgattttgactcaaactctaaagtcttgagtgtttcaaagtcagtcgttacctgtttaaaagcctcagcctttagcttattcctccttcaatacacgggacctttggttaatttggggcaggaaaactcttaaagtaatctctcttggcagaggccttattgcaccagagggaaaaagtatatacttcatttgctgttactccagttatgccttaaattcatttgcttggtaatcctatcaacgagcactaacttcttagtatactttaaacacttagttgggtaacaactgagattttgttgtcctttattttttgctgagatggagtcagtcagatgttagtcatagctaacaccgaatttgtgttgtcatttagacagttactgattcgatctgctttatatatgagaacgtatttttaactattccaagaaggaagaggtagctaaatgtaatcccctcttcctatccccccagaaaactgaactgtaagttctaggtagactaattgggagcagacacggagttttagatgccttagccaaacccagcagaaacctttcacacagccactcatcgtaagaaacgcagatttttctcttctcatgcttgtctctggttccctgcatttgtagtgacagaactttcactagcaggatataaagaaagtaattatgcttggagtccctctttactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatcctttttggaggattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcct

SEQ ID NO: 191229 - DNA, 583 bp, Homo sapiens
  Payload ID: 17774
  Gene Name: thyroid hormone receptor interactor 12
  ENST ID: ENST00000343290
  CDS Start-End: 287-583
ataattgaaggaacccggagccgccgccgccgcgccgctggggggggtggggggagctagtggaagttactgccgcgccaccgagtccggaccggagactttggggcctaactagacagagtctccctctgttgcccaggctggagtgcagtggcgcggtctcagctcactgcaacctctgcctcccgggttcaagcgattcccctgccgcagcctccagagcagctgggactacagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaa

SEQ ID NO: 191230 - DNA, 6405 bp, Homo sapiens
  Payload ID: 17774
  Gene Name: thyroid hormone receptor interactor 12
  Uniprot ID: Q14669
  ENST ID: ENST00000389044
  CDS Start-End: 170-6292
agctgataattgaaggaacccggagccgccgccgccgcgccgctggggggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcagcctctagttctgttgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtagga

SEQ ID NO: 191231 - DNA, 5355 bp, Homo sapiens
  Payload ID: 17774
  Gene Name: thyroid hormone receptor interactor 12
  Uniprot ID: Q14669
  ENST ID: ENST00000389045
  CDS Start-End: 74-5242
ccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcagcctctagttctgttgcaggggctgttggcatgaccacctctggggagagtgaatcagatgattccgagatgggacgtttgcaagctttgttagaggcaaggggtcttccccctcacctatttggtcctcttggtcctcggatgtcacagcttttccatagaacaattggaagtggagctagttctaaggcccagcagctactacaaggattgcaagccagtgatgaaagtcaacagcttcaggcagttattgagatgtgtcagttactggtcatgggaaatgaggagacactgggagggtttcctgtcaagagtgttgttccagctttgattacgttacttcagatggagcacaattttgatattatgaaccatgcttgtcgagccttaacatacatgatggaagcacttcctcgatcttctgctgttgtagtagatgctattcctgtctttttagaaaagctgcaagttattcagtgtattgatgtggcagagcaggccttgactgccttggagatgttgtcacggagacatagtaaagccattctacaggcgggtggtttggcagactgcttgctgtacctagaattcttcagcataaatgcccaaagaaatgcattagcaattgcagctaattgctgccagagtatcacgccagatgaatttcattttgtggcagattcactcccattgctaacccaaaggctaacacatcaggataaaaagtcagtagaaagcacttgcctttgttttgcacgcctagtggacaacttccagcatgaggagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaaacattgcagaaacgcttcactttctcctgtgtggtgcctccaatggaagttgtcaggaacagattgatcttgttccacgaagccctcaagagttgtatgaactgacatctctgatttgtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaagtcacattgcttccatgctgtcaagccaagacctgaagatagtagtgggagcacttcagatggcagaaattttaatgcagaagttacctgatatttttagtgtttacttcagaagagaaggtgtaatgcatcaagtaaaacacttagcagaatcagagtctttgttgacaagtccaccaaaggcatgtacgaatggatcgggatccatgggatccacaacttcagtcagcagtgggacagccacagctgccactcatgctgcagctgacttgggatcacccagcttgcagcacagcagggatgattctttagatctcagccctcaaggtcgattaagtgatgttctaaagagaaaacgactgccaaaacgagggccaagaaggccaaagtactcacctccaagagatgatgacaaagtagacaatcaagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataatagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccacttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagagggtatggaagagtaagagaagatgatgaagacagcgatgacgatggatcagatgaggaaatagatgagtctctggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggtataaacctgtgagagaggatgaagaaagtaataaagattgtgttggtggtaaaagaggaagagcccaaacagctccaacgaaaacttcccctagaaatgcaaaaaagcatgatgagttatggcacgatggagtgtgcccatcagtatcaaatcctttagaagtttacctcattcccacaccacctgaaaatataacatttgaagacccgtcattagatgtgatccttcttttaagagttttacatgctatcagtcgatactggtattacttgtatgataatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctgcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaacgtactgtgaaccgagaggagctgctgaaacaggcggagtctgtgatgcaggacctcggcagctcacgggccatgttagaaatccagtatgaaaatgaggttggtacaggtcttgggcctacactggagttttatgcgcttgtatctcaggaactacagagagctgacttgggtctttggagaggtgaagaagtaactcttagcaatccaaaagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggttatattctgggcactaaatgaaggcgtttctaggcaatttgattcgttcagagatggatttgaatcagtcttcccactcagtcatcttcagtacttctacccggaggaactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtagga

SEQ ID NO: 191232 - DNA, 1507 bp, Homo sapiens
  Payload ID: 17774
  Gene Name: thyroid hormone receptor interactor 12
  ENST ID: ENST00000409677
  CDS Start-End: 123-1415
gggggtggggggagctagtggaagttactgccgcgccaccgagtccggaccggagactttggggcctaactagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcagaagagggattcaggacatcttaattaaagaacagtttcaacggcacaagaaatttgtcaaaagccacatataaatgaaaaacaagcataaaaatacaacctttttaatactaaaa

SEQ ID NO: 191233 - DNA, 719 bp, Homo sapiens
  Payload ID: 17774
  Gene Name: thyroid hormone receptor interactor 12
  ENST ID: ENST00000430954
  CDS Start-End: 149-719
gcggccgcggccggagggaccggggcctggcgggaggtaggggtcgctgggtccctcctccggcttcccgcaatgaggagggcccttcacagaaccgggtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtcacatttagggcaggcaaaacataagggatatagccctcctgagagtagaaaatctaattctaaggcacccaaagtgcagtctaatactacttctgaactgtcaaggggacacctttctaaaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaa

SEQ ID NO: 191234 - DNA, 652 bp, Homo sapiens
  Payload ID: 17774
  Gene Name: thyroid hormone receptor interactor 12
  ENST ID: ENST00000453485
  CDS Start-End: 1-652
agcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagaggtcttctaagtcagagacatcaaaacctggaccttctggattacaggccaaattagcaagtttaagaaaatctacgaagaaacgcagtgagtctccacctgctgagctccccagtttgaggcggagcacacgccaaaagaccacgggctcctgtgctagtaccagtcggcgaggctctggcctgggcaaaagaggagcagctgaagctcgtcgacaggagaaaatggcagaccctgaaagcaaccaggaggcagtaaattcttcagctgctcggacagatgaagctc

SEQ ID NO: 191235 - DNA, 562 bp, Homo sapiens
  Payload ID: 17774
  Gene Name: thyroid hormone receptor interactor 12
  ENST ID: ENST00000418123
  CDS Start-End: 1-562
ttaatggccaaggctatcatggatttcagattggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagactggatcagctcctttgtggcagtaaagcagacacttgggatgcaaagacactgatggaatgctgtaggcctgatcatggttatactcatgacagtcgggctgtgaagtttttgtttgagattctcagtagttttgataatgagcagcagaggttatttctccagtttgtgactggtagcccaagattgcctgttggag

SEQ ID NO: 191236 - DNA, 603 bp, Homo sapiens
  Payload ID: 17774
  Gene Name: thyroid hormone receptor interactor 12
  ENST ID: ENST00000435716
  CDS Start-End: 142-603
gtcattatgggtggggctgaagcgcagagcagctgaaacatttttataccaccacccgcacactttcaatgggatagaagggactccaaaagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagt

SEQ ID NO: 191237 - DNA, 584 bp, Homo sapiens
  Payload ID: 17774
  Gene Name: thyroid hormone receptor interactor 12
  ENST ID: ENST00000428959
  CDS Start-End: 138-584
aaatggaaactaggaagcagctccagtgacaacagttgtgggaagcgagggtcagagaagggagaggccagagagactttagaccgcatgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaaga

SEQ ID NO: 191238 - DNA, 2672 bp, Homo sapiens
  Payload ID: 17775
  Gene Name: thyroid hormone receptor interactor 13
  Uniprot ID: Q15645
  ENST ID: ENST00000166345
  CDS Start-End: 357-1655
gtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaa

SEQ ID NO: 191239 - DNA, 746 bp, Homo sapiens
  Payload ID: 17775
  Gene Name: thyroid hormone receptor interactor 13
  ENST ID: ENST00000513435
  CDS Start-End: 1-746
ctggagtggggggaactcagcggcggggccagaccttcacagaccctccttatgtccacggagggtggattgaggtcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgag

SEQ ID NO: 191240 - DNA, 2045 bp, Homo sapiens
  Payload ID: 17776
  Gene Name: thyroid hormone receptor interactor 4
  Uniprot ID: Q15650
  ENST ID: ENST00000261884
  CDS Start-End: 61-1806
ggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagagtctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 191241 - DNA, 847 bp, Homo sapiens
  Payload ID: 17776
  Gene Name: thyroid hormone receptor interactor 4
  ENST ID: ENST00000558820
  CDS Start-End: 10-141
ctggggaagatggcggtggctggggcggtgtccggggagccgctggtgcactggtgcacccagcagttgcggaagactttcggcctggatgtcagcgaggagatcattcaggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaa

SEQ ID NO: 191242 - DNA, 558 bp, Homo sapiens
  Payload ID: 17776
  Gene Name: thyroid hormone receptor interactor 4
  ENST ID: ENST00000558162
  CDS Start-End: 1-334
ctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagagtctgattctccatttgttttcatctgcaaaaatcctcaggaaatggttgtgaagtttcctattaaaggaaatccaaaaatctgcagcctagaggatgaaagaacgtctgaattcctgggaatatcctggaaatccttgttcctcttgtatcttgtttctcctattagctttccattttagacatcatcattgaagccagagattagtctgcctacaattgagtgttttattctgatgggttgatcttacctgagctggtctcacttgagggctttcataatcatactggagtttcctgaaacgtaaaataggaatgttctcattcagtaaagctttaagaatgtgaagaaaatgatatgtctttttttcttatgaagaatctgaaataaataataattaaaaga

SEQ ID NO: 191243 - DNA, 1536 bp, Homo sapiens
  Payload ID: 17776
  Gene Name: thyroid hormone receptor interactor 4
  ENST ID: ENST00000560567
  CDS Start-End: 6-1112
ggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctg

SEQ ID NO: 191244 - DNA, 565 bp, Homo sapiens
  Payload ID: 17776
  Gene Name: thyroid hormone receptor interactor 4
  ENST ID: ENST00000560920
  CDS Start-End: 3-383
agatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcag

SEQ ID NO: 191245 - DNA, 521 bp, Homo sapiens
  Payload ID: 17776
  Gene Name: thyroid hormone receptor interactor 4
  ENST ID: ENST00000560475
  CDS Start-End: 1-184
ggagctgagagaacttcgacacgcctctcgactttctaagaaggtcaccattgactttgcaggaaggaagatcctggaagaagaaaattcactagcagagtatcatagcagtttccagacatcagtcaagagtctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 191246 - DNA, 1942 bp, Homo sapiens
  Payload ID: 17777
  Gene Name: thyroid hormone receptor interactor 6
  Uniprot ID: Q15654
  ENST ID: ENST00000200457
  CDS Start-End: 361-1791
cggggcccggacgcatccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaaca

SEQ ID NO: 191247 - DNA, 646 bp, Homo sapiens
  Payload ID: 17777
  Gene Name: thyroid hormone receptor interactor 6
  ENST ID: ENST00000429658
  CDS Start-End: 1-646
ctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtgtctcgctctgttgcgcagactggagtgcagtggggtgatctctgctcactgcaacctcagcctgccctggttcaagcgattctcatgcctcaggctcccgagcagttgggattacaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcgg

SEQ ID NO: 191248 - DNA, 875 bp, Homo sapiens
  Payload ID: 17777
  Gene Name: thyroid hormone receptor interactor 6
  Uniprot ID: Q15654
  ENST ID: ENST00000437505
  CDS Start-End: 105-347
gttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctt

SEQ ID NO: 191249 - DNA, 992 bp, Homo sapiens
  Payload ID: 17777
  Gene Name: thyroid hormone receptor interactor 6
  Uniprot ID: Q15654
  ENST ID: ENST00000417475
  CDS Start-End: 112-432
agaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgcc

SEQ ID NO: 191250 - DNA, 1303 bp, Homo sapiens
  Payload ID: 17777
  Gene Name: thyroid hormone receptor interactor 6
  Uniprot ID: Q15654
  ENST ID: ENST00000619988
  CDS Start-End: 1-243
atgtcggggcccacctggctgcccccgaagcagccggagcccgccagagcccctcaggggagggcgatcccccgcggcaccccggggccaccaccggcccacggagcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctga

SEQ ID NO: 191251 - DNA, 1163 bp, Homo sapiens
  Payload ID: 17777
  Gene Name: thyroid hormone receptor interactor 6
  ENST ID: ENST00000629911
  CDS Start-End: 147-1163
cccaaaattagggaggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggtgagtggctggggctgggaggagggagtcagtggctggatgcagggggcttccatccaaggtggtaacagcgtccaagaccaaaggaggaacggtgctaaaagccaggcgactgaaagtgatgtacaaacagggcggaattctgcaagtatcaagcaagtagct

SEQ ID NO: 191252 - DNA, 2538 bp, Homo sapiens
  Payload ID: 17778
  Gene Name: thyroid hormone receptor, alpha
  Uniprot ID: P10827
  ENST ID: ENST00000264637
  CDS Start-End: 581-2053
gaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 191253 - DNA, 2260 bp, Homo sapiens
  Payload ID: 17778
  Gene Name: thyroid hormone receptor, alpha
  Uniprot ID: P10827
  ENST ID: ENST00000394121
  CDS Start-End: 557-2029
agcagattgttgggggaaatggctggtgacagagaatagaaagagcctatatggagaagggtgacgttggaaaagggaggcagtggatcggtattgatgttagaaatgagaggggagggaggtaacagggaatgaacccccacaaggatgaaaaacgtaagatgattgaagttaaaaggacatcaggggtcacctgcccagccctcgcagctgaagcttgaggaagctctgcccccgacagcagtggcgatttgtcaagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcc

SEQ ID NO: 191254 - DNA, 4895 bp, Homo sapiens
  Payload ID: 17778
  Gene Name: thyroid hormone receptor, alpha
  Uniprot ID: P10827
  ENST ID: ENST00000450525
  CDS Start-End: 492-1724
gcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccctttagcactctgtttccctgtttcccatctgtcttctgggctctctctaacctctgccctcctccccagctcctactcactgcactaactctgggcgggcaggtaccagaatgggggtgtttagataagtgacacttagttggggccccaggggaggggtggtcggtgctcctttttctttaaagctcttttggccagctgcccctctgccccgggaccccttcccctcttcttttctctaattcagggactttggcttgagcccctctcgccctcctggtgagggtgctctgttggtctgcacttgggtgagctgtcctcctccccctccctgtggctgccgcccactcctcaggggagagagggagagaggaggtggtcctcccatgggagcaggaggtggggtgggacagagcagaccagagggtgctgggctcagggctgcatgtcggcagggatggatgggtggacacagatgcccccggaagccatggggattggggcagggggtggggggaggggtgccagggcttcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccctgctggggcctcgggctgcccgcgctgtctttgtctctatcctctctctctctcctggagtactgaatcctgtattactccagtcccatgggtaggccctcttgtaccttcctaccacgcctgggggcccagtggaattcctgacctgtctgctgtcttccccatccctccatccccaccccaacccctccatccccattctcagccatggacacggcagagaaaaggccttgaagagccttagcctcttataggcacttgggactcccccaccctccccaatcatatgagctgtgatcccatcctccccggacccctcccttccccctcggtgatgtggggtgtatgtgtgcgttcctctgcgtgaatgtgtgagtgagtacacatggtaggggaggagccagggcgactcaggagtgccacgcacctgctctagagcggcagctgtcccagtccctgctgtggaagtgggggacagggccctctcctgggggccattggtgctaatgagggggatggccttgatgtgggtgctcagcatgcctcccccagtattggcccggggcactagggcaggcagggtggagcagcaggtgcagtatcggtgggaggacgggttgctgggaataggacgagggggccaggccaggacaaggggttgccagagccatgaccactaccccgcccccaccacccgcctctccatctcagtattgcccctcccatcactcataacacacatacctcatccagcctcctccctgctcagacttggggagggtgggggaggagcccctaccccttctcctggtggcgggtctgcagggctgggagagggcagggcgttgtgagagagagaccgtccataaggaggacagtaactcctgccctgggaactcctgggcgggggggagggggacactgcccagaggcgctactgaatgtatgagaagctggtgctgggctggggggaggggggttgtggccagaaacagggaaggaggtaggtctcttccccagggaggggtgggaccggcaggggtgacttgaggggctcctactcctgccccacgttgacaatcagtatgtctgttatgtgcgatttttcaccccgttgtgttttgggtcaggattttaaagaaagatatttttatggtaattgttgctcgtctattttactatatatttatgtaataaatatatgatgaaaataa

SEQ ID NO: 191255 - DNA, 1909 bp, Homo sapiens
  Payload ID: 17778
  Gene Name: thyroid hormone receptor, alpha
  Uniprot ID: P10827
  ENST ID: ENST00000546243
  CDS Start-End: 403-1635
gtgcacgcatccatgtgagagtgtttttgtgcatgtgtgggctggggagggctctgaatatctcctggaacggtacccagagccctgtggctctgcgcatgcgggggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcag

SEQ ID NO: 191256 - DNA, 574 bp, Homo sapiens
  Payload ID: 17778
  Gene Name: thyroid hormone receptor, alpha
  ENST ID: ENST00000585047
  CDS Start-End: 357-574
gatcctgagatgaaaggtgctctggcgtcactgggttggttttatgtccatgaatgcagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctg

SEQ ID NO: 191257 - DNA, 2421 bp, Homo sapiens
  Payload ID: 17778
  Gene Name: thyroid hormone receptor, alpha
  Uniprot ID: P10827
  ENST ID: ENST00000584985
  CDS Start-End: 581-1936
gaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 191258 - DNA, 581 bp, Homo sapiens
  Payload ID: 17778
  Gene Name: thyroid hormone receptor, alpha
  ENST ID: ENST00000577288
  CDS Start-End: 487-581
atactcccagcacaaagagaagtgctgtgatcctgaggccgacagtggctgggaagggagggcagcctgccatttcctttgtatggcccctccctccaggccctgagagctgctctgctttatacttttggcttccatatcatactaccctatcccctcctttaactggagtgggagaactgcggaaagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggcca

SEQ ID NO: 191259 - DNA, 907 bp, Homo sapiens
  Payload ID: 17778
  Gene Name: thyroid hormone receptor, alpha
  ENST ID: ENST00000578218
  CDS Start-End: 654-907
agcagattgttgggggaaatggctggtgacagagaatagaaagagcctatatggagaagggtgacgttggaaaagggaggcagtggatcggtattgatgttagaaatgagaggggagggaggtaacagggaatgaacccccacaaggatgaaaaacgtaagatgattgaagttaaaaggacatcaggggtcacctgcccagccctcgcagctgaagcttgaggaagctctgcccccgacagcagtggcgatttgtcaaggtcacacagtgagttaccggcggagaagggacccgaactcccaaacaaactacacctgcaagcgtttggtgtttagactttctccccgatgtataagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacct

SEQ ID NO: 191260 - DNA, 563 bp, Homo sapiens
  Payload ID: 17778
  Gene Name: thyroid hormone receptor, alpha
  ENST ID: ENST00000577486
  CDS Start-End: 392-563
acatttggagttaaggctgggcaggagagagggatggggaaataaacatggtggcttaggttggcactgctccaggtctgcaatgtagcaactgggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtgggg

SEQ ID NO: 191261 - DNA, 1718 bp, Homo sapiens
  Payload ID: 17779
  Gene Name: thyroid hormone receptor, beta
  Uniprot ID: P10828
  ENST ID: ENST00000280696
  CDS Start-End: 242-1672
cagaagagctcaaaagacacctcggtctaaataggattttagcacatcaggtgctattacaaagtaaagcaggctgggttgctgtgttggtggtggtgtttattcatcttcccttcgcgtttcatgtgtatgtatgtatgcttctctgcgtatatgcccagctctcagggtgtatggggctggagaatgcatgcgtagactgtgtgtatatgtaaactagaaactgaaccagggaaacaaaatgaactactgtatgcaagaaatatatgaagtgcacccagctgccggcagcaattgctacatgcagtccactgattattacgcgtattttgaagatagtccgggttacagcggttgcgatgctcaggctgtgcccagtaacaacatatatatggaacaggcctgggcagtgaatcagccttatacctgtagttaccctggaaacatgtttaaaagcaaggactctgacttggacatggccctgaatcaatacagccaacctgaatatttcactgaagaaaagcctactttttctcaagtgcagtcgccatcgtattctcaaaaaaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtc

SEQ ID NO: 191262 - DNA, 6345 bp, Homo sapiens
  Payload ID: 17779
  Gene Name: thyroid hormone receptor, beta
  Uniprot ID: P10828
  ENST ID: ENST00000356447
  CDS Start-End: 286-1671
cggcggggattaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaaggaaaatattttttttcagtgagcccagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaacagatttctctatggatcaaatattctaatcaaggaaagatacggtgaaacttcagtcttcttctggagaaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacagtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagcccctcacctgtgccccgggcgacagctcttcagtgtgcagtgcaggcctggggtggactgccaggccttcgctctgtgccagcaacgccgttcttgttgctcctccatgaacaggggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaaaccagactgggggaaaaaaggtttggccttatcacagaatttttactgtgctgtataaatgtttgcaaatgcgaaaagtgtgcatttatagtgtgtttccacattaattaatgccgccttcaagagcaatattgtgcaggtaaaacgctgtttgtggctttctgttgcacagttaaagctgacccaccctatgcacaagacaatcaaatataaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacagatata

SEQ ID NO: 191263 - DNA, 7506 bp, Homo sapiens
  Payload ID: 17779
  Gene Name: thyroid hormone receptor, beta
  Uniprot ID: P10828
  ENST ID: ENST00000396671
  CDS Start-End: 397-1782
cggcggggattaactttgcatgaataatgtgagtgcgcttggaaaagagacctcctgctccgcgggctcggggcaagagcccgcaggctaccttccccgggcaggggcgctcaacccaaccggctccagggcactgatctgcgatttccttctggttggctgtcctgcgtgggtgccaagttccacacatgatttaatgaataagaagctcgccagagaggcaaactccagcattttatatttcatctgcccccagtgacttcactgtaggaagaggaaatgcagaaaaacaaacgtcttgaagactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaaggaaaatattttttttcagtgagcccagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaacagatttctctatggatcaaatattctaatcaaggaaagatacggtgaaacttcagtcttcttctggagaaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacagtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagcccctcacctgtgccccgggcgacagctcttcagtgtgcagtgcaggcctggggtggactgccaggccttcgctctgtgccagcaacgccgttcttgttgctcctccatgaacaggggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaaaccagactgggggaaaaaaggtttggccttatcacagaatttttactgtgctgtataaatgtttgcaaatgcgaaaagtgtgcatttatagtgtgtttccacattaattaatgccgccttcaagagcaatattgtgcaggtaaaacgctgtttgtggctttctgttgcacagttaaagctgacccaccctatgcacaagacaatcaaatataaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacagatatattttcctgtctctttctttaaatattattattttctacataggcaaagagttgcctgctcttctcacttcagctgctgccaaaagacggaaccacggatgtaaggacatttatttcataaataaacatctactagaataagcaaatttacttgagaagaaactatggagggagagaagaaactaagtaaaatgctgatggggggttacctctttggaaggggccacaaagatgaagggaggagagaggtgaagttttgcagctcaaggacaacattcatcttctcatctcaaattattcaggaatattactaatggaattatgttaacatcagctgccaacatatatctcaatctctgttgccctgaacacatgttaattgagattctttctatgacaagtaacaaaaagctaactcaaactggcttaagcagaaagctaattattgactttaatatctgggatctagggtattgcataccaaagcttcaggcatggctggatctgggtgcacttactcagtattctcaggaagctcctttttttgtcattcatgtagacttaacattcacatggcctttcaccttacggtggcctccaatagctccaggatgagctttacagctccaaatatagtgaaaggagaatttcttttctccaacaattctaatgaaaattctggcctaattctcactggcccaagttcagtcatgtgcccattcctgagccaatcactgtggtgaggaaaacagatgcataaccaaccttatcctcaggaatcctggaactgggtgaggggaaagagggacagtcagcttcatctaaactatggactgagagttgaggcaagatgattcctgaaagaaaattctaagtcttgctgctataagtggaagagaatggtgggcaagcaaaagcaaccagtgcccacaccaaaggtaaatctaaaacaacatcccatttcagtacagcaagcggttctccttcacacagaggaagctcatctccaagtttttatttggccaggacatgaaccaaataaacaccttcc

SEQ ID NO: 191264 - DNA, 754 bp, Homo sapiens
  Payload ID: 17779
  Gene Name: thyroid hormone receptor, beta
  ENST ID: ENST00000447875
  CDS Start-End: 389-754
ggcaagagcccgcaggctaccttccccgggcaggggcgctcaacccaaccggctccagggcactggtcagccagttcctgaggatcatcctgataaactccacaatgggtcactaacagggccacttcttgctcatgatctgcgatttccttctggttggctgtcctgcgtgggtgccaagttccacacatgatttaatgaataagaagggggcttggaggctcatagcaaaggtccttgaagagagcaagaaaaagtcttcccaggaaaagtggacacctgagtgagtgttacaacgagaaggggggcatcccaggcaaggcagctaccaagcacaggtgtgaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatc

SEQ ID NO: 191265 - DNA, 592 bp, Homo sapiens
  Payload ID: 17779
  Gene Name: thyroid hormone receptor, beta
  ENST ID: ENST00000418247
  CDS Start-End: 404-592
atgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaagggggcttggaggctcatagcaaaggtccttgaagagagcaagaaaaagtcttcccaggaaaagtggacacctgagtgagtgttacaacgagaaggggggcatcccaggcaaggcagctaccaagcacaggtgtgaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttgg

SEQ ID NO: 191266 - DNA, 568 bp, Homo sapiens
  Payload ID: 17779
  Gene Name: thyroid hormone receptor, beta
  ENST ID: ENST00000431815
  CDS Start-End: 226-568
aatgtgagtgcgcttggaaaagagacctcctgctccgcgggctcggggcaagagcccgcaggctaccttccccgggcaggggcgctcaacccaaccggctccagggcactgatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagcca

SEQ ID NO: 191267 - DNA, 575 bp, Homo sapiens
  Payload ID: 17779
  Gene Name: thyroid hormone receptor, beta
  ENST ID: ENST00000447414
  CDS Start-End: 265-575
atttcctcgctgcgcccctggcggagccgggtttgcctgctcttggccgccgccgccaccgccgcgcaagtcggacagccgtgagggctggaggggaaaccaggtcaccggttcgcagacgcggcgcggagcaggcgccccgggcccggaatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaagga

SEQ ID NO: 191268 - DNA, 539 bp, Homo sapiens
  Payload ID: 17779
  Gene Name: thyroid hormone receptor, beta
  ENST ID: ENST00000428492
  CDS Start-End: 337-539
ctcctgctccgcgggctcggggcaagagcccgcaggctaccttccccgggcaggggcgctcaacccaaccggctccagggcactgatctgcgatttccttctggttggctgtcctgcgtgggtgccaagttccacacatgatttaatgaataagaagggggcttggaggctcatagcaaaggtccttgaagagagcaagaaaaagtcttcccaggaaaagtggacacctgagtgagtgttacaacgagaaggggggcatcccaggcaaggcagctaccaagcacaggtgtgaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatatt

SEQ ID NO: 191269 - DNA, 671 bp, Homo sapiens
  Payload ID: 17779
  Gene Name: thyroid hormone receptor, beta
  ENST ID: ENST00000415021
  CDS Start-End: 306-671
cttccccgggcaggggcgctcaacccaaccggctccagggcactgatctgcgatttccttctggttggctgtcctgcgtgggtgccaagttccacacatgatttaatgaataagaagctcgccagagaggcaaactccagcattttatatttcatctgcccccagtgacttcactgtaggaagaggaaatgcagaaaaacaaacgtcttgaagactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatc

SEQ ID NO: 191270 - DNA, 896 bp, Homo sapiens
  Payload ID: 17779
  Gene Name: thyroid hormone receptor, beta
  ENST ID: ENST00000413780
  CDS Start-End: 501-896
cggcgcggccctggctgcggccgcctctcttcgcccaaggagttgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggattaactttgcatgaataatatctgcgatttccttctggttggctgtcctgcgtgggtgccaagttccacacatgatttaatgaataagaagctcgccagagaggcaaactccagcattttatatttcatctgcccccagtgacttcactgtaggaagaggaaatgcagaaaaacaaacgtcttgaagactgaaagcctgttattcaaagaggttagcagtagactgttggaagtaagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaa

SEQ ID NO: 191271 - DNA, 2571 bp, Homo sapiens
  Payload ID: 17779
  Gene Name: thyroid hormone receptor, beta
  Uniprot ID: P10828
  ENST ID: ENST00000416420
  CDS Start-End: 510-1895
aactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaagggggcttggaggctcatagcaaaggtccttgaagagagcaagaaaaagtcttcccaggaaaagtggacacctgagtgagtgttacaacgagaaggggggcatcccaggcaaggcagctaccaagcacaggtgtgaagtgacttcactgtaggaagaggaaatgcagaaaaacaaacgtcttgaagactgaaagcctgttattcaaagaggttagcagtagactgttggaagtaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaagg

SEQ ID NO: 191272 - DNA, 703 bp, Homo sapiens
  Payload ID: 17779
  Gene Name: thyroid hormone receptor, beta
  ENST ID: ENST00000453729
  CDS Start-End: 340-703
tgacattttgcaggactcgcgcgacgcccagtcgccggcgctccccgggaccccgccgccgggaggagggggcggaggagggtggagactgcggggcttggccaaggaaggcgcacatcctcgggcgggcggccgtgacgcggcggggattaactttgcatgaataatgtcctagaaaggaaagcacagcacatcgtgcagaaggccgcatgggaaaagggccagatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgta

SEQ ID NO: 191273 - DNA, 1174 bp, Homo sapiens
  Payload ID: 17780
  Gene Name: thyroid hormone responsive
  Uniprot ID: Q92748
  ENST ID: ENST00000281030
  CDS Start-End: 22-462
attgtgtcagaggaagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcacaagcttatgaaaactaaacatgatgaatcaaaagcacttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgta

SEQ ID NO: 191274 - DNA, 2923 bp, Homo sapiens
  Payload ID: 17781
  Gene Name: thyroid peroxidase
  Uniprot ID: P07202
  ENST ID: ENST00000346956
  CDS Start-End: 2-2671
aatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 191275 - DNA, 3145 bp, Homo sapiens
  Payload ID: 17781
  Gene Name: thyroid peroxidase
  Uniprot ID: P07202
  ENST ID: ENST00000345913
  CDS Start-End: 92-2893
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatt

SEQ ID NO: 191276 - DNA, 3138 bp, Homo sapiens
  Payload ID: 17781
  Gene Name: thyroid peroxidase
  Uniprot ID: P07202
  ENST ID: ENST00000329066
  CDS Start-End: 84-2885
aggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 191277 - DNA, 2283 bp, Homo sapiens
  Payload ID: 17781
  Gene Name: thyroid peroxidase
  Uniprot ID: P07202
  ENST ID: ENST00000382198
  CDS Start-End: 1-2283
atgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctga

SEQ ID NO: 191278 - DNA, 2956 bp, Homo sapiens
  Payload ID: 17781
  Gene Name: thyroid peroxidase
  Uniprot ID: P07202
  ENST ID: ENST00000382201
  CDS Start-End: 73-2703
catttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagatta

SEQ ID NO: 191279 - DNA, 1155 bp, Homo sapiens
  Payload ID: 17781
  Gene Name: thyroid peroxidase
  ENST ID: ENST00000382269
  CDS Start-End: 87-611
ggaaggcaattaaggcgcccatttcagaagagttacagccgtgaaaattactcagcagtgcagttggctgagaagaggaaaaaagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaa

SEQ ID NO: 191280 - DNA, 542 bp, Homo sapiens
  Payload ID: 17781
  Gene Name: thyroid peroxidase
  ENST ID: ENST00000423320
  CDS Start-End: 28-542
actctgtctccttccgttaattttagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggc

SEQ ID NO: 191281 - DNA, 1282 bp, Homo sapiens
  Payload ID: 17781
  Gene Name: thyroid peroxidase
  ENST ID: ENST00000446278
  CDS Start-End: 1-1214
cctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggcc

SEQ ID NO: 191282 - DNA, 5391 bp, Homo sapiens
  Payload ID: 17781
  Gene Name: thyroid peroxidase
  ENST ID: ENST00000422464
  CDS Start-End: 1-2595
cagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtggggaggtgctggtcacaggcacaaagtctcaggcaggaggagggcgcctcaggtctgctgcacggcatggggcgcacgcttcctcataatgatcgcatgtttcaaaattgctaaaacaataggtttttttttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcacaggagggctatgaacattttgcttcaggatgttttatttcgctctactgttatgtagagaaagcatggtttgctttttataacttttgtgacccaaaaataccagactgttgttttccctaggtgccaggccatcctgttctgtgtgttcccaaactcttagttttgttcatgtaaaactcatgatttcataattaaaacaatattaaaataaaactcatgaatgatttcataattaaaacaatattaaaaat

SEQ ID NO: 191283 - DNA, 1267 bp, Homo sapiens
  Payload ID: 17781
  Gene Name: thyroid peroxidase
  ENST ID: ENST00000469607
  CDS Start-End: 1-1092
tatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgca

SEQ ID NO: 191284 - DNA, 1157 bp, Homo sapiens
  Payload ID: 17781
  Gene Name: thyroid peroxidase
  ENST ID: ENST00000539820
  CDS Start-End: 92-616
ggaaggcaattaaggcgcccatttcagaagagttacagccgtgaaaattactcagcagtgcagttggctgagaagaggaaaaaaggtcagaatgagagcgctcgctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcag

SEQ ID NO: 191285 - DNA, 1157 bp, Homo sapiens
  Payload ID: 17781
  Gene Name: thyroid peroxidase
  ENST ID: ENST00000617910
  CDS Start-End: 92-616
ggaaggcaattgaggcgcccatttcagaagagttacagccgtgaaaattactcagcagtgcagttggctgagaagaggaaaaaaggtcagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgtctctgccccagctgctgggcgggctccactgacgctcctgggagaatctctgctgaccacacaatgacattggcactgggagctgtgatctggggacacttagatctgagctggtttctctccttctgtggtgacagctacagttttcattaagaattcacagcatctggatctaaaatctcctacgttcaaggcttcacacattgtattccaccaaaaataaaacatctgctcag

SEQ ID NO: 191286 - DNA, 2761 bp, Homo sapiens
  Payload ID: 17781
  Gene Name: thyroid peroxidase
  ENST ID: ENST00000622050
  CDS Start-End: 92-2761
ggaaggcaattgaggcgcccatttcagaagagttacagccgtgaaaattactcagcagtgcagttggctgagaagaggaaaaaaggtcagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctga

SEQ ID NO: 191287 - DNA, 2893 bp, Homo sapiens
  Payload ID: 17781
  Gene Name: thyroid peroxidase
  ENST ID: ENST00000613631
  CDS Start-End: 92-2893
ggaaggcaattgaggcgcccatttcagaagagttacagccgtgaaaattactcagcagtgcagttggctgagaagaggaaaaaaggtcagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggagagtgctgggatggaaggccgggatactcacaggctgccgagagccctctga

SEQ ID NO: 191288 - DNA, 2649 bp, Homo sapiens
  Payload ID: 17781
  Gene Name: thyroid peroxidase
  ENST ID: ENST00000627917
  CDS Start-End: 73-2649
catttcagaagagttacagccgtgaaaattactcagcagtgcagttggctgagaagaggaaaaaaggtcagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcag

SEQ ID NO: 191289 - DNA, 2934 bp, Homo sapiens
  Payload ID: 17781
  Gene Name: thyroid peroxidase
  ENST ID: ENST00000625793
  CDS Start-End: 1-2595
cagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtggggaggtgctggtca

SEQ ID NO: 191290 - DNA, 2229 bp, Homo sapiens
  Payload ID: 17781
  Gene Name: thyroid peroxidase
  ENST ID: ENST00000625313
  CDS Start-End: 1-2229
atgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaaatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcag

SEQ ID NO: 191291 - DNA, 542 bp, Homo sapiens
  Payload ID: 17781
  Gene Name: thyroid peroxidase
  ENST ID: ENST00000628844
  CDS Start-End: 28-542
actctgtctccttccgttaattttagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggc

SEQ ID NO: 191292 - DNA, 1042 bp, Homo sapiens
  Payload ID: 17781
  Gene Name: thyroid peroxidase
  ENST ID: ENST00000626753
  CDS Start-End: 1-1042
cctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtg

SEQ ID NO: 191293 - DNA, 2831 bp, Homo sapiens
  Payload ID: 17781
  Gene Name: thyroid peroxidase
  ENST ID: ENST00000627010
  CDS Start-End: 84-2831
aggcaattgaggcgcccatttcagaagagttacagccgtgaaaattactcagcagtgcagttggctgagaagaggaaaaaagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagagaccaccccagatggggcgcctccaacacggccctggcacgatggctccctccagtctatgaggacggcttcagtcagccccgaggctggaaccccggcttcttgtacaacgggttcccactgcccccggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggagggtctgactgccagatgacttgtgagaaccaaaacccatgttttcccatacaactcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcag

SEQ ID NO: 191294 - DNA, 1038 bp, Homo sapiens
  Payload ID: 17781
  Gene Name: thyroid peroxidase
  ENST ID: ENST00000626995
  CDS Start-End: 1-1038
tatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaagactccgggaggctccctcgggtgacttggatctccatgtcgctggctgctctgctgatcggaggcttcgcaggtctcacctcgacggtgatttgcaggtggacacgcactggcactaaatccacactgcccatctcggagacaggcggaggaactcccgagctgagatgcggaaagcaccaggccgtagggacctcaccgcagcgggccgcagctcaggactcggagcag

SEQ ID NO: 191295 - DNA, 1155 bp, Homo sapiens
  Payload ID: 17781
  Gene Name: thyroid peroxidase
  ENST ID: ENST00000629774
  CDS Start-End: 87-611
ggaaggcaattgaggcgcccatttcagaagagttacagccgtgaaaattactcagcagtgcagttggctgagaagaggaaaaaagaatgagagcgctggctgtgctgtctgtcacgctggttatggcctgcacagaagccttcttccccttcatctcgagagggaaagaactcctttggggaaagcctgaggagtctcgtgtctctagcgtcttggaggaaagcaagcgcctggtggacaccgccatgtacgccacgatgcagagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacggatgctttatcagaagatctgctgagcatcattgcaaacatgtctggatgtctcccttacatgctgcccccaaaatgcccaaacacttgcctggcgaacaaatacaggcccatcacaggagcttgcaacaacagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgtctctgccccagctgctgggcgggctccactgacgctcctgggagaatctctgctgaccacacaatgacattggcactgggagctgtgatctggggacacttagatctgagctggtttctctccttctgtggtgacagctacagttttcattaagaattcacagcatctggatctaaaatctcctacgttcaaggcttcacacattgtattccaccaaaaataaaacatctgctcagaaa

SEQ ID NO: 191296 - DNA, 4400 bp, Homo sapiens
  Payload ID: 17782
  Gene Name: thyroid stimulating hormone receptor
  ENST ID: ENST00000298171
  CDS Start-End: 157-2451
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtg

SEQ ID NO: 191297 - DNA, 1281 bp, Homo sapiens
  Payload ID: 17782
  Gene Name: thyroid stimulating hormone receptor
  Uniprot ID: P16473
  ENST ID: ENST00000342443
  CDS Start-End: 251-1012
gtccagccaaggaaagtgaagcaagcagacttgtttgggtcaaggttgcctagggaagcggagcacttaagtgcctctttttccccttctccagcctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacata

SEQ ID NO: 191298 - DNA, 4566 bp, Homo sapiens
  Payload ID: 17782
  Gene Name: thyroid stimulating hormone receptor
  ENST ID: ENST00000541158
  CDS Start-End: 323-2617
caggggtgcagggcgacggcttcggccgcaccgcgggctagccagggctgcgtgcccgcctctgaccctcagcagaggtgtctctggccaggaggagctgaagttctgcaggacattggtccgcccgcggacagtccactccgcggggactttctctggataaggacctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtg

SEQ ID NO: 191299 - DNA, 1089 bp, Homo sapiens
  Payload ID: 17782
  Gene Name: thyroid stimulating hormone receptor
  Uniprot ID: P16473
  ENST ID: ENST00000554435
  CDS Start-End: 27-851
agaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaat

SEQ ID NO: 191300 - DNA, 557 bp, Homo sapiens
  Payload ID: 17782
  Gene Name: thyroid stimulating hormone receptor
  ENST ID: ENST00000555326
  CDS Start-End: 53-391
gagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacataacagatacggatgcattatagtgactgtgttccttgtaacttatacagagaaattcggaataccaggaacttaacttacatagaccctgatgccctcaaagagctccccctcctaaagttccttggcattttcaacactggacttaaaatgttccctgacctgaccaaagtttattccactgatata

SEQ ID NO: 191301 - DNA, 1184 bp, Homo sapiens
  Payload ID: 17782
  Gene Name: thyroid stimulating hormone receptor
  ENST ID: ENST00000554263
  CDS Start-End: 27-722
agaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgtgagtaagacatacaaaagaatattttagtctttttttttctttttttttttttggaataaatggagacattaaggggagaatcttatgttcaagggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaa

SEQ ID NO: 191302 - DNA, 537 bp, Homo sapiens
  Payload ID: 17783
  Gene Name: thyroid stimulating hormone, beta
  Uniprot ID: P01222
  ENST ID: ENST00000256592
  CDS Start-End: 39-455
gggtcaccacagcatctgctcaccaatgcaaagtaagcatgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaaatattatgtttcacattatcttctg

SEQ ID NO: 191303 - DNA, 474 bp, Homo sapiens
  Payload ID: 17783
  Gene Name: thyroid stimulating hormone, beta
  Uniprot ID: P01222
  ENST ID: ENST00000369517
  CDS Start-End: 1-417
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaa

SEQ ID NO: 191304 - DNA, 4394 bp, Homo sapiens
  Payload ID: 17784
  Gene Name: thyrotrophic embryonic factor
  Uniprot ID: Q10587
  ENST ID: ENST00000266304
  CDS Start-End: 117-1028
attgggcgcctgcgcagtagctgcccgtgtcggcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 191305 - DNA, 4386 bp, Homo sapiens
  Payload ID: 17784
  Gene Name: thyrotrophic embryonic factor
  Uniprot ID: Q10587
  ENST ID: ENST00000406644
  CDS Start-End: 201-1022
agctggcaggtggccgagccgggggtggacgggcgggctgggactggtgctggccattggctgcctcaaggctcccaccccgcctgcctccctagcctgcggctggcggcccctgcctctccagctgcctctgaactccctggagcaagcacctcctgctgggctgtgtgagctgcgactggttctcagtggcccctgccatggacatgcctgaggtcctcaagtccctgctggagcactctctgccttggccagagaagagaacagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgag

SEQ ID NO: 191306 - DNA, 551 bp, Homo sapiens
  Payload ID: 17784
  Gene Name: thyrotrophic embryonic factor
  ENST ID: ENST00000413942
  CDS Start-End: 1-551
gcttcatctttttgcctaggccaggaacgtcactggggcgtatacggaaagcagataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatg

SEQ ID NO: 191307 - DNA, 1978 bp, Homo sapiens
  Payload ID: 17785
  Gene Name: thyrotropin-releasing hormone
  Uniprot ID: P20396
  ENST ID: ENST00000302649
  CDS Start-End: 528-1256
tctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccgcgtcccagatctttcaatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggccttctgctggggctcctggatgacctgagtaggagccagggagctgaggaaaagcggcagcaccctggtcggcgggcagcctgggtcagagagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatca

SEQ ID NO: 191308 - DNA, 1580 bp, Homo sapiens
  Payload ID: 17785
  Gene Name: thyrotropin-releasing hormone
  ENST ID: ENST00000507066
  CDS Start-End: 145-861
agatataagcggcggcccatctgaagagggctcggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccaggcgtcccagatctttcaatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggccttctgctggggctcctggatgacctgagtaggagccagggagctgaggaaaagcggcagcaccctggtcggcgggcagcctgggtcagagagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataa

SEQ ID NO: 191309 - DNA, 10733 bp, Homo sapiens
  Payload ID: 17786
  Gene Name: thyrotropin-releasing hormone degrading enzyme
  Uniprot ID: Q9UKU6
  ENST ID: ENST00000261180
  CDS Start-End: 97-3171
aagaaaaagaagaagaaaaagaagaggaagaagaagaaggaggaggaggaggaggaggagggggccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacgtgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagttctcctgtgtcagtcttgcctatagattttgccatcgttttctgtcaaagttccttttgcatgaaacaattatgcaaacttataattattagtgctgaaaaagagtttattttccatcttgtttgttttcctaccttatgctgagtagtccagagagttaaaaaaattctctgcatgttggtcttttaagtctgttttgctctaatcctccattaagcgagcatacctcaagtgggtctattagcatttaatgaccttttgtgccagttgtgccatcccttaagatgaaaagttccttttcttgtgttaatgtacaaagcttttcttttggcactgacaactgtgttctacctgggaattttgaatagccattttcatggctgtgtgttgtgtaacacaaatgtttttaaatggtattctcacccagtaggccagctctccaaacgttgcttagatgcttcaaaattagcatattttaagtttaccagtataaaataccaatgcaactactctacatagccaaatgtttgtaaatcacgtcttattttcctgaggtttttcactccaccaaatcttacaaatcattgaaagaaatatattctaacagtacgcactgaatagtgaaaataattagacattttaagaaccagagccatagaattattttaaattagtagaaaagaggagctatttccgaatctatagaataaagtaccacctaaaactgaattttatcatataagcaagtaatacctattagtcatacctaaatttttcagcacttcattcaattaaaatacatgaattttaaatattttacatgatgtgaataggcatgataatacttttagtataaaatctaaactttttccatttatcagaaatgataaaatccagttaccacatatcacgtttataaaatccttaattaaatgagtaacttctaaaatataacaatactaaatatcacactgcgatggaggtcccaaatatgtggtctatcaccactgaattcatgtaatagataagaaaaaaattagaggtggatgtcttgttttgtgtcatgaattactaaaatctcttagtagttgtggtatatttttgagtaaaattaccatttccagatttgagtttgaagggcttttatagttgtattttcctcctcactgttaataatcataatcctttttcagtattttagtggccttgaacaactggtttatctacaatctcaaatcctaagtgtataattatgtgcaatgttcaatacctcatataatacttgctcaacagtatagtggtaccaatggcattaagatggtgtttttgttctacatatttttcaataatttattctttctaatgttgaaattatatcaggctttaccggtttttttagttgtttaaataagtaatattttcaaaagaataaaataaccaatgatatctcttggaataatctgtaaaacgtagttataaaattctattttctacttagagtttttatcttttcttttttgtcggctttacaaattatatgtatgcatgaaataactaactgttgaaagtgtccaacctccagccatagcaatttgctgtgccaatatgtgtacaaaaaagtagtttcaattagaaaggacaacattatttatcacattgagtattaaacatttccaggtaactcgtaaataaaaagatttccccatttttacacattttttcttaaaatttttctataatctttgaagtttctaaaatacacaatctcaacctctaagactaacatctacaatactaggtctattcttgagtttcaataacatgtattttagttgggtcataaacttgcattattttatattatctccaggacaattatatcataggactaagatttttgtgatagtattatttacaaatattataagtataatatcttgtgaggctattattaaggttatgccatgtattgataaaatgcattgctttctcaaagaactgttacacattttgttttatttgactcatcacaaaaacataataaatgttgtgagccctaatattctgatgagaaaactggggctcaggtagcaacatgagctatttaaaactacaaaatagggctgggcacagtggctcatgcctgtaatcccagcactttgggaggctgagggtgggaggatcacttgagcccaggggtttgagaccagtctgggaaacatattgaggccccatttctataaaaataaaaatgaaaactagccaggcatggtggtgtgcacctgttgtcccagctactggggaggctgaggtgggagaattatttaagtccaaaagttcagtgctctagtgagctatgatcactgtactccagcctgggtgacagagtgagatcctgtctctaaaaaaataaaataaaatcacaatgtttgttgttattttgggaaccaatataacaacctaagtctatcacaacatcattccccaactaaaatataaatatatgttgaaaatatctctatcgattgcattaattggagattttccaaatactagaccagcatcaaaatacacagttaaatatatttgcaataattccattgtttgttaacttttgcatttctaatttgcaggatgttaaacaactggatgaaatgttatgatttaatttggtcagtataaataatcaaatattgggacaaataatttaattcatttagtttattaattatatttcctgtctgtatcttttattgaacattgtttaaacataaccttaaagtactgataatttgcttaattttcaacacaaatttatctgacaaattctgtctatagtaacagatggtcagaatgcagataaattgtgtgcatctcaatcagtaaaaataatattcagtaaaatgtctataaatctatgcagattaagttgtgaaaaacaatgcaattttagtactactggattagatgcagtaaaggaatccctaaggaagtttacaataatatatttaattaaaatctactggcaattagaattttaaggaattcttttctaagaagttggagaacctaaaatagcttgcttattcgcctgggtactctcatgaagtaaccatgtacacctaataaagaaatagtaaaagcacatataatgaaaaataattaagatttcttacacctgattttttcattatcagagataattatcagagataatttttcattatcagagatcatagctgaattatcatttgacaatacataagaatatatattgtatagatacaatatataactatacttaaagaaatatttattgagcatcttttatttcacaaggcacttagtgagggaaaggaatacagagatgaatatggcctgaaggaatgaactcatattacaataaatgaaaaagaaaaagaaataatgaaccaagggaatgagggcaacaggaaaaataattccttgctacagacgggaagtcaatcatttttaggtatacataatattatacaactatttttgtacactagttctcaaaacatttatgatacctagtataatttttattgtttgatttcctagtgcttacttgtgttttacagaaatatgttacattttgaaattataataaaataatagagtttaaactctaataattggaatataaattgggatggaatttatccttaagaaaagctgtttaaacaatttagtagtattagtaagttgcaggaatactttaatctacttacgaaaaagtagttcaagttttctaaaatggtttcagcatactatcggtatctcacaatgtgttaattttaagttaattatatattctttaaagcagattaaataatacttgtcctaagcataatttatttgttgaaattagtatatgtgaacttatgaaaaaatgttcttgtaaattattctagaatcccaaattttaattatataagaacaaccttttgttcaattgctttgaactaatgatgaagttttttaaaatattaagtattttatttaatgtgatatagattcaggaaaagtctaacaaaaatgtacttcagtagttttatttttattttgtgaaattttattttaaagtttaggtaaggaaagtttttaaactgtcttaaatatttaataaaagcagttgttaaaaatatatgttctaatgttaactatatgacatatatgccattgcatgcattttgttttttaaataggtttttcaccactggccccactagtagatgattttaccccagattttgaaaacataccactttaatggcctttatttcaaatacttcgtactttagggatagtattttgaagatgtttatcttttgtacattcctagttcatttattaatgtactaagaaaaagaaaacaaaatgactgattcttttgttttgaattaaatgtttgtgctgtattaatgttaagtgagttaagataaagggaagctacaaaaatttgaatgcctactaaatgctaggcactttataggtgtcttctaatatatgtctattggtatcacatcaattaataaccctgtgaaatgtcattagctctaattcaccaaagagtagatggaggcagagttgttatcagtttacataattaattagtggtattcacttggattcaaaactctgcaaactgaagccttatatagctcaaactagtcattaatctgccctcagcatgtatgaaaacataatgtttatccgtacagaccattctctatagcagatttgaataggtacttagcacactttatcattgtcactggctctttcgaaagaagtattaatttgtgcattctggtttaccattcatttcttaacaaagttgctttatacgttccataaaaagttttcatgaaaacattttacattagcatgttgtgtagtgggttttaagttataacaggtaattaacagatatttcggccaacgagacacacacacacatgaaaaaaataagtgaaaagacagaataaattgcaaaggttttacgagtggaccacaaagttaaggttaaacttctgtctttgcatgtggaggagacatattagtctagccagaactttccttttgcttagcagtgaggtcagagaagtatctctgtcattctgcttagaagtatacatggactgcaattgcttaatttacttaaacttaacattttcaatgggtttgctgtgtgaagatacagtctaagataagtgctttgacttgcctctgcagaggtcaacttatttctcatcacacacatttttcttatgtcatataagtaaaggaaagagtgaaacgttttatagaaaatattacagtggagttaagaacatctgcctcaaatgtacagtgcatttactttttaagttaatcatttagtagctacccttttaacctctactatgttcacagtattgcatttgctcttgtaaacaattttgttcccacctttacatagcgtatgacctactcagtgagaacattcattattaagtttttgctattaattttcatttaaaataggtttattaactagcaaatctcaaatgcaaaacatttttgagtgaatttttcctcaaatgttgtattctacctttcaaaatattgtgtaacagcaattccacattatccttttgaatgctacctatatattgccacatataaagatatttttcatttttcatttttcattgctatcttttaatccctttgcattttgataatatcgaaaacagattagggctgaaaaactaaaaaagattagggcttgtattatgcattgtctagttacttgaacaataagagaaattctatctttgagctttcataattggctttctggacaccactgagtttattagataatctttaaaaatattatgaactattttgagtggacctaaatttattcagtaataaagtttactttcctaaatccattccccaagtgaacaggcttatttaaaatatgtcatataaaagcacttttcctttctaacattttatgatttaggaattaaaaagtagctgttctttcagtaaataagtgttaataaagcagtgaccaaataaataaccttttgttagtttagcagataaatgttttcaatgtatgcctttaaaattattcagtaaaaattgaattagtacgtattcaacatgaaatttttagtcttttctgaccaagcactaataaaattgatttccctaaatgagaaaatttgtcttctgtattttaagcagaaaaaatatgaattctgcctctgataatcaaattttgtacagcaatgtgtaatgtgtcacaatttaaaaagttttaattttctgacatgcagataaggccaaaataaataataccatctgtttttttcacttgaaaatacatttttaaaattttgagtatatatattatagaggtccatgcaaatggaaaaaaattattctcttctgacatggactttttcatgactatacacatgctgaggctagaataaaaacatatatttgtgctatattgtaaaaataaaaacaatttgttctcctttctaattatatgcctttagaataaatgaaatgatctgc

SEQ ID NO: 191310 - DNA, 582 bp, Homo sapiens
  Payload ID: 17786
  Gene Name: thyrotropin-releasing hormone degrading enzyme
  ENST ID: ENST00000547300
  CDS Start-End: 1-582
tatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtaggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaac

SEQ ID NO: 191311 - DNA, 1415 bp, Homo sapiens
  Payload ID: 17787
  Gene Name: thyrotropin-releasing hormone receptor
  Uniprot ID: P34981
  ENST ID: ENST00000311762
  CDS Start-End: 90-1286
gggggatggaactgctgcaataaaggtgggcgctggaaagaagatgttttgagaagtcagtgtttccgagaaactttaagcttctaaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaaatgagaatctgtgcagtcatcaacaaaagggagaacatggccaatagtcatatgtgaagacagagcagatcagtctttgtcaatgctctaacaaa

SEQ ID NO: 191312 - DNA, 1660 bp, Homo sapiens
  Payload ID: 17787
  Gene Name: thyrotropin-releasing hormone receptor
  Uniprot ID: P34981
  ENST ID: ENST00000518632
  CDS Start-End: 352-1548
tgttctcattaggggacgatctatgatttgacagcctcactgctgctgctcctgctgctgcttctgcttctgccgcggctgtatggtttgtcattagttggaaagggctgtgagggtttggagaaactgcagttttaaagactgagcactgctaagtggtctccctctcaaatagagtagacaagattttctgcaagattagaaacttggaactattaccacttcatctacccagaaaatcaggcagcgctacagaggataagggggatggaactgctgcaataaaggtgggcgctggaaagaagatgttttgagaagtcagtgtttccgagaaactttaagcttctaaagatggaaaacgagacagtcagtgaactgaaccaaacacagcttcagccacgagcagtggtggccttagaataccaggtggtcaccatcttacttgtactcattatttgtggcctgggcattgtaggcaacatcatggtagtcctggttgtcatgagaaccaagcacatgaggacccccacaaactgctacctggtgagcctggcagtagctgatctcatggtcttggtggccgcaggcctccccaacataacagacagtatctacggttcctgggtctatggctatgttggatgcctctgcattacttacctccagtatttgggaattaatgcatcctcttgttcaataacagcctttaccattgagaggtacatagcaatctgtcaccccatcaaagcccagtttctctgcacattttccagagccaaaaagattatcatctttgtctgggctttcacatctctttactgtatgctctggttcttcttgctggatctcaatattagcacctacaaagatgctattgtgatatcctgtggctacaagatctccaggaattactactcacctatttacctaatggactttggtgtcttttatgttgtgccaatgatcctggctaccgtcctctatggattcatagctagaatccttttcttaaatcccattccttcagatcctaaagaaaactctaagacatggaaaaatgattcaacccatcagaacacaaatctgaatgtaaatacctctaatagatgtttcaacagcacagtatcttcaaggaagcaggtcaccaagatgctggcagtggttgtaattctgtttgcccttttatggatgccctacaggactctagtggttgtcaactcatttctctccagtcctttccaagaaaattggtttttgctcttttgcagaatttgcatttatctcaacagtgccatcaacccggtgatttacaatctcatgtcccagaaattccgtgcagccttcagaaagctctgcaactgcaagcagaagccaacagagaaacctgctaactacagtgtggccctaaattacagcgtcatcaaggagtcagaccatttcagcacagagcttgatgatatcactgtcactgacacttacctgtctgccacaaaagtgtcttttgatgacacctgcttggcttctgaggtatcctttagccaaagttgattcatgaattagaagaaaatggatgacaaagaaaatgagaatctgtgcagtcatcaacaaaagggagaacatggccaatagtcatatgtgaagacagagcagatcagtcttt

SEQ ID NO: 191313 - DNA, 3823 bp, Homo sapiens
  Payload ID: 17788
  Gene Name: TIA1 cytotoxic granule-associated RNA binding protein
  ENST ID: ENST00000282574
  CDS Start-End: 151-1308
ttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataa

SEQ ID NO: 191314 - DNA, 543 bp, Homo sapiens
  Payload ID: 17788
  Gene Name: TIA1 cytotoxic granule-associated RNA binding protein
  ENST ID: ENST00000361692
  CDS Start-End: 1-457
atacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaa

SEQ ID NO: 191315 - DNA, 1440 bp, Homo sapiens
  Payload ID: 17788
  Gene Name: TIA1 cytotoxic granule-associated RNA binding protein
  ENST ID: ENST00000445587
  CDS Start-End: 181-1038
ggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcgtcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaa

SEQ ID NO: 191316 - DNA, 4647 bp, Homo sapiens
  Payload ID: 17788
  Gene Name: TIA1 cytotoxic granule-associated RNA binding protein
  Uniprot ID: P31483
  ENST ID: ENST00000433529
  CDS Start-End: 212-1372
aggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 191317 - DNA, 911 bp, Homo sapiens
  Payload ID: 17788
  Gene Name: TIA1 cytotoxic granule-associated RNA binding protein
  ENST ID: ENST00000454815
  CDS Start-End: 568-911
gaagtcaaagtgaattgggcaacaacccctagcagtcaaaagaaagatacaagcagtagtaccgttgtcagcacacagcgttcacaagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatt

SEQ ID NO: 191318 - DNA, 4633 bp, Homo sapiens
  Payload ID: 17788
  Gene Name: TIA1 cytotoxic granule-associated RNA binding protein
  Uniprot ID: P31483
  ENST ID: ENST00000415783
  CDS Start-End: 231-1358
aactttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaatcgtttctttataggaggttattacatttcattacagtcactgcattttgactgttgtgtttagaatttgaatgtacatccaaaatgatgagtttcaatttaagagccttaataaaatgtgtgagtgtgtctcaattgaa

SEQ ID NO: 191319 - DNA, 821 bp, Homo sapiens
  Payload ID: 17788
  Gene Name: TIA1 cytotoxic granule-associated RNA binding protein
  Uniprot ID: P31483
  ENST ID: ENST00000416149
  CDS Start-End: 25-669
ggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaa

SEQ ID NO: 191320 - DNA, 904 bp, Homo sapiens
  Payload ID: 17788
  Gene Name: TIA1 cytotoxic granule-associated RNA binding protein
  ENST ID: ENST00000477044
  CDS Start-End: 182-667
gggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagtcttagttcacttgcacatggattcacataaactgaatggtgtaatgtctgggcaaccaaaactgttggcttttgagaaaactgtcaaatactttaacatcaaactgttgcaatgcaagatcatttccatgtctttgttggtgatctcagcccagaaattacaactgaagatataaaagctgcttttgcaccatttggaagaatatcagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaaga

SEQ ID NO: 191321 - DNA, 915 bp, Homo sapiens
  Payload ID: 17788
  Gene Name: TIA1 cytotoxic granule-associated RNA binding protein
  ENST ID: ENST00000474809
  CDS Start-End: 229-663
ctttgctggctgctcctaggctcccggctcgccgccatcttgtattggggtttcattgttcccgctgggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcagtagtaccgttgtcagcacacagcgttcacaagatcatttccatgtctttgttggtgatctcagcccagaaattacaactgaagatataaaagctgcttttgcaccatttggaagaatatcagtgtctctgaagaatggacagaattgccctggctaactacaagctacggttcacagtggataaatagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaatttt

SEQ ID NO: 191322 - DNA, 490 bp, Homo sapiens
  Payload ID: 17789
  Gene Name: TIA1 cytotoxic granule-associated RNA binding protein-like 1
  ENST ID: ENST00000369086
  CDS Start-End: 48-305
ttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtct

SEQ ID NO: 191323 - DNA, 5072 bp, Homo sapiens
  Payload ID: 17789
  Gene Name: TIA1 cytotoxic granule-associated RNA binding protein-like 1
  Uniprot ID: Q01085
  ENST ID: ENST00000369093
  CDS Start-End: 31-1209
ttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttttttgtttttgtttttttttttttttttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaatgtttttggaaaagttaatttatattttatagggagaacactcaataaattatgttaactgtgcccccgagttaaaaattttatgagtatatgtgaaacttgaacaactgaagactttttttaattgataaaaatgcttagtatgcctgttttggtctgccagtaaattaagtagcttattgagataactaacagctaaatatagctgtagtgtttcctgactgtatattctatgatttaataaaattatccagactagttatattgccacagtaaacatgtgactgaagtgtccttcatcttaatctgaaagagggcaaaatttcatgatcagttaatggaagttatttcatattaagtggtttttttttttttttttttttagatggagtcttgctctgtcgccaggctggagtacatgtagtgatgagaacttggctcaccgcaacctctgcttcccagattcaagcgattctcctgcctcagcctcctgagtagctgggattacagtcacgtgccaccatgcccagctaatttttttgtgtttttagtagagatgggggtttcaccatgttggccaggatggtctcgatctcctcacctcgtgatccgcccgcctcagtctcccaaagtgctgggactacaagcgtgagccacggtgtctggcttttttttttttttttttttgagacggagtcttgccctgtcgccaggctggagtgcagtggtgcaatctcggctcaccgcaacctccgcctcctgggttcaagctattctcctgcctcagcctcccgagtagctggactacagatgcatgccaccatgtctagtaaatttttgtatttttagtagagacagggtttcaccatgttggccaggatggtctcaatctcctgacctcgtgatccacccacctcggcctcccaaggtgctgggattacaggcgtgagccactgcacctggccattaagtggtttttaaaatacaaagctacttatccaaatgaaatgtaccatttaaaaactacaactgggccgggcgcagtggctcagcctgaccaacatgatgaaaccctgtctccactaaaaatacaaaattaagcgtggtggcccgtgcctgtagtctcaactactcaggaggctgaggcaggagaatctcttgaacccaggaggcggaggttgccctgagccaagattgtgctattgcactccaccctgggaaatagagcaagactccgtctcaaaaaaaaaaaaagtgcaactgttgccgggcatggtggttcacacctgtaatcccagcactttgggaagctgaggcgggtagtggatcacctaaggtcaggagtttgagaccagcccagccaacatggtgaaaccccatctctactaaaaataacaaaaaaattagctgggcgtgctggtgggcgctggtagtcccagtgacttgggaggctgaggcaggagaattgaacctgggaggtggaggttgcagtgagctgaaaatgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatgataa

SEQ ID NO: 191324 - DNA, 1401 bp, Homo sapiens
  Payload ID: 17789
  Gene Name: TIA1 cytotoxic granule-associated RNA binding protein-like 1
  Uniprot ID: Q01085
  ENST ID: ENST00000436547
  CDS Start-End: 46-1173
accctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaa

SEQ ID NO: 191325 - DNA, 515 bp, Homo sapiens
  Payload ID: 17789
  Gene Name: TIA1 cytotoxic granule-associated RNA binding protein-like 1
  ENST ID: ENST00000412524
  CDS Start-End: 118-515
aaaaaagaaagaaagaaagaaagaaagaaaagatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattg

SEQ ID NO: 191326 - DNA, 2321 bp, Homo sapiens
  Payload ID: 17789
  Gene Name: TIA1 cytotoxic granule-associated RNA binding protein-like 1
  ENST ID: ENST00000497671
  CDS Start-End: 565-972
tcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctatacgtaggtaacctttccagagatgtgacagaagtccttatacttcagttgttcagtcagattggaccctgtaaaagctgtaaaatgataacagagcatacaagcaatgacccatattgctttgtggaattttatgaacacagagatgcagctgctgcattagctgctatgaatgggagaaaaattttgggaaaggaggtcaaagtaaactgggcaaccacaccaagtagccagaaaaaagatacttccaatcacttccatgtgtttgttggggatttgagtccagaaattacaacagaagatatcaaatcagcatttgccccctttggtaaaatatcaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatggatgcccgggtagttaaagacatggcaactggaaaatccaaaggctatggttttgtatctttttataacaaactggatgcagaaaatgcgattgtgcatatgggcggtcagtggttgggtggtcgtcaaatccgaaccaattgggccactcgtaaaccacctgcacctaaaagtacacaagaaaacaacactaagcagttgagatttgaagatgtagtaaaccagtcaagtccaaaaaattgtactgtgtactgtggaggaattgcgtctgggttaacagatcagcttatgagacagacattctcaccatttggacaaattatggaaataagagttttcccagaaaagggctattcatttgtcagattttcaacccatgaaagtgcagcccatgccattgtttcggtgaacggtactacgattgaaggacatgtggttaaatgctattggggtaaagaatctcctgatatgactaaaaacttccaacaggttgactatagtcaatggggccaatggagccaagtgtatggaaacccacaacagtatggacagtatatggcaaatgggtggcaagtaccgccttatggagtatacgggcaaccatggaatcaacaaggatttggagtagatcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaa

SEQ ID NO: 191327 - DNA, 485 bp, Homo sapiens
  Payload ID: 17789
  Gene Name: TIA1 cytotoxic granule-associated RNA binding protein-like 1
  ENST ID: ENST00000479729
  CDS Start-End: 168-254
gcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctacacacacaagctaagacatatggttctatcttcagaaaacaatatggtgtttagagcctaggtagcaattatatatttaaagacttggatctttagcttgactatttcataaccagagcagaaagaaagtgaagtgtagaagctataatttggaacgaataaagatgtcatttcaatgaactaccaagagatgatcttactagatacgtaggtaacctttccagagatgtgacagaagtccttatacttcagttgttcagtcagattggaccctgtaaaagctgt

SEQ ID NO: 191328 - DNA, 2625 bp, Homo sapiens
  Payload ID: 17790
  Gene Name: tigger transposable element derived 1
  Uniprot ID: Q96MW7
  ENST ID: ENST00000408957
  CDS Start-End: 711-2486
gcggctatctcgggacgccagctcagggcggctgcgcagagggctggactcagcggcggagctggctgctggcctcagttctgcctctgtccaggtccttgtgacccgcccgctctcctaagggagcgtgtcctggccccctcccgcagcggctcggaaaaaaggcagcaccgcgtcgttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaactttttcatgatttctgtgtctgttatggtgatctatgatcagtgatctttgatgttgctattgtcattgttttggggtgccacatacagcgtcttttataagacgtggaacttaatgttgtgtgtgttctgaccgctccacccacagaccgttccccatctctctccctcttcttgggcctccctattccctgagacacaacaatattgagattaggcgaattaatgactctgcaatggcctctaagtgctcaagtgaaaggaagagtcgcacatctctcactttaaatcaaaaactagaaatgattaaactgagtgaggaaggtatgtcaaaagccgagataggccgaaggctaggcctcctgcggcaaacagttagccaagttgtaaatgcaaaggaaaagttcttgaaggaagttaaaagtgctactccaatgaacacacgaatgataagaaagcgaaacagccttattgctgatatggagaaggttttagtggtctggatagaagatcagaccagccgcaacattcccttaagccaaagcctaatccagaacaaagccctaactctcttcaactctatgaaagctgagagaggtgtggaagctgcagaagaaaagtttgaagctagcagaggttggttcatgaggtttaaggaaagaagccatttccataacataaaagcacaaggtgaagcagcaagtgctgatgtagaagctgcagcaagttatccagaagctttagctaagatcattgacgaaggtggctacactaaacaacagattttcaatgtagatgaaacagccttctattggaagaagatgccatctagaactttcatagctagagaggagaagtcagtgcctggcttcaaagcttcaaaggacaggctgactctcttgttaggggctaatgcagctggtgactttaagttgaagccaatgcttatttaccattctgaaaatcctagggcccttaagaattatactaaatctactctacccgtgctatataaatggaacagcaaagcccggatgacagcacatctgtttacagcgtggtttactgaatattttaaacccactgttgagacctactgctcagaaaagaagattcctttcaaaatattactgctcattgacaatgcccctagtcatccaagagctctgatggagatatacgaggagattaatgttattttcatgcctgctaacacaacatccattctgcagcccatggatcaaggggtaatttcgaccttcaagtcttattatttgagaaatacatttcataaggctctagctgccatggatagtgatgtctctgatggatctgggcaaagcaaattgaaaaccttctggaaaggattcaccattttagatgccattaaaaacattcgtgattcatgggaggaggtcaaattgtcaacattaacaggagtttggaagaagttgattcccaccctcattgatgactatgaggggttcaagacttcagtggaggaagtaagtgcagatgtggtggaaatagcaaaagaactagaattagaagtagagcctgaagatgtaactgaattgctgcaatctcatgataaaactttaacagatgaggagttgtttcttatggatgcgcaaagaaagtggtttcttgagatggaatctacacctggtgaagatgctgtgaacattgttgaaatgacaacaaaggatttagaatattacataaacttagttgataaagcagcagcagggtttgagaggattgactccaattttgaaagaagctctactgtgggcaaaatgctatcaaacagcatcgcatgctacagagaaatctttcatgaaaggaagagtcaactcatgcgaaaagcttcaccgatgtcttattttaggaaattgccacagccaccccaaccttcagcagccaccaccctgaccagtcagcaaccatcaacctcgaggcaagaccctccaccagcaaaaagagtacgactcaccgaaggctcagattgataatcagcattttttagcaataaagtatttttaaatttaggtatgtatattgttttattagacaatgctattgcactcttgctggtctacagtatagtgtaaacataacttttatatgcattgggaaaccaaaaacatt

SEQ ID NO: 191329 - DNA, 2083 bp, Homo sapiens
  Payload ID: 17791
  Gene Name: tigger transposable element derived 2
  Uniprot ID: Q4W5G0
  ENST ID: ENST00000317005
  CDS Start-End: 159-1736
gattcacgtagaccttgtcaggaaattggtcactatccatctaggccctagaagtgagaggaggaatcttacgaactcattttctagttgctttgtattcaaatcttagttgttaattatcttgttctagtaatcacctaaaatattagacacttaaaatgttggggaaacgtaagcgtgtggtgttgacaattaaggacaagcttgacattattaagaaacttgaggaaggcatctctttcaaaaaactttccgtggtgtacggaattggtgaatccacagttcgtgatattaaaaagaacaaagaaaggattataaactatgcaaacagttcagatcctaccagtggagtatccaaacgtaaatctatgaagtcatcaacatacgaggagcttgatagagttatgatagagtggtttaaccaacagaaaacagatgggattccagtgtccggaacgatttgtgcaaaacaagccaagttcttttttgatgctttgggaatggaaggtgattttaatgcatcgtcaggctggctaactcgatttaagcagcgccatggtattccaaaggctgctggtaaaggaacaaaattaaaaggagatgaaactgctgccagagaattttgtggtagctttcaggaatttgttgaaaaagagaatctacaaccagagcaaatttatggtgctgatcaaactggattgttttggaaatgtctaccatcaaggacattaactcttgaaactgaccaaagtacttctgggtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctgaggaccagaccaaggctgctgagcaaaagccttccagtaagagtagaaaaacagaactgaatccagagaagcatattagccataaagcggcacttgaatggactgaaaatttactggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaattagatgtcagtttggattacttaaattacaactctttaatgttgactctagtcattgggcattgacgtgtaacttgtctttctactgtttctaatatctattaattagatcataaggtacctgaggccagggatcttgtgtctgttgtgcctgaatttggcgtgtctaataaaggcccatgcacactataggcactcaataaaacttacatttttatgatttttctttg

SEQ ID NO: 191330 - DNA, 3217 bp, Homo sapiens
  Payload ID: 17791
  Gene Name: tigger transposable element derived 2
  Uniprot ID: Q4W5G0
  ENST ID: ENST00000603357
  CDS Start-End: 1293-2870
acaacgttctgcgggggcgcgcgcgtgctctctaatcccccgccttccggctccggcggcgacgctcgtccctctccgctcgtccctcgccgctgccgggccaccagtgccagcctgcctcaggagactccatttgcgcttagtgtggtctgggcgccgcgcaggcggtcccagggcgatgcccggggccggcggactggcgttccctgtgccaagcggccgcccgctggctggctggctgcagcagtgacatcctggtcgccggcgtccaggcggaatccgggctccctccgcgggaggaaagacgtcccgcgctctgaagctcgcccagcggggagaggccctcgctaacacggcttctccctgacctcttaatttcaggaggtttcggagcctccgagtatctctacagcccccacaggaactgcttctgttggtccatcgaggatcgtctttcaccaggattattgtaacatcatcttcaccgagcctgccaccccatagcctctaccttgggtcctcatttccaccgatgcagtttttttgatgctttctttagtaatgtgacatcacatgtccactatcctcctttccagctgccaaatctagtaggtttaagtcgcttttaaagtagagttttctgcctgttccactttcaccttatttgcactgttcacttctgtccgggtcatcttctcttgcgtatgatttccacaagcactcacttgcgcaacctatagcagagtccgtgcctagagagacagcattccatacaatccactgcttgacaaagaccacatagtcagagggtgagttttcccattgtattttcctgtatgtcaagtttgcaagtcctctcttgacttaaactgtttactccctagcacatttcctaaaatacttccacctgagatttagtggctattctggcaaagaacattacctgcaaggatggcaagaattgagtatgcaatagtactgttttagaagccttaccagtacagtttctagcctctagtgtgattgcacttcatgaaagaccctgaaccctgaggaggaagaaagatagaagataagagttaattggcgctaggctttgttgtaggaagtttgtaagttttaaaatagcaagtagattcacgtagaccttgtcaggaaattggtcactatccatctaggccctagaagtgagaggaggaatcttacgaactcattttctagttgctttgtattcaaatcttagttgttaattatcttgttctagtaatcacctaaaatattagacacttaaaatgttggggaaacgtaagcgtgtggtgttgacaattaaggacaagcttgacattattaagaaacttgaggaaggcatctctttcaaaaaactttccgtggtgtacggaattggtgaatccacagttcgtgatattaaaaagaacaaagaaaggattataaactatgcaaacagttcagatcctaccagtggagtatccaaacgtaaatctatgaagtcatcaacatacgaggagcttgatagagttatgatagagtggtttaaccaacagaaaacagatgggattccagtgtccggaacgatttgtgcaaaacaagccaagttcttttttgatgctttgggaatggaaggtgattttaatgcatcgtcaggctggctaactcgatttaagcagcgccatggtattccaaaggctgctggtaaaggaacaaaattaaaaggagatgaaactgctgccagagaattttgtggtagctttcaggaatttgttgaaaaagagaatctacaaccagagcaaatttatggtgctgatcaaactggattgttttggaaatgtctaccatcaaggacattaactcttgaaactgaccaaagtacttctgggtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctgaggaccagaccaaggctgctgagcaaaagccttccagtaagagtagaaaaacagaactgaatccagagaagcatattagccataaagcggcacttgaatggactgaaaatttactggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaattagatgtcagtttggattacttaaattacaactctttaatgttgactctagtcattgggcattgacgtgtaacttgtctttctactgtttctaatatctattaattagatcataaggtacctgaggccagggatcttgtgtctgttgtgcctgaatttggcgtgtctaataaaggcccatgcacactataggcactcaataaaacttacatttttatgatttttctttg

SEQ ID NO: 191331 - DNA, 2012 bp, Homo sapiens
  Payload ID: 17792
  Gene Name: tigger transposable element derived 3
  Uniprot ID: Q6B0B8
  ENST ID: ENST00000309880
  CDS Start-End: 208-1623
ccggcgcgggcggcgcgcacgggactctgctgtgcgcgcgcccgcccgcccgccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgccccggagaggccatggagctgagcagcaagaagaagcttcacgccctgtccctggccgagaagatccaggtgctggaactcctggatgagtccaagatgtcccagtcggaggtggcccggcgcttccaggtttcccagccccagatctcgcgcatctgcaagaataaggagaagctgctggcggactggtgcagcggcacagccaaccgagagcgcaagcgcaagcgggagtccaagtacagcgggatcgacgaggctctgctctgctggtaccacattgcccgggccaaggcctgggacgtgacggggcccatgctgctccacaaagccaaggagctggccgatatcatgggccaggacttcgtgcccagcatcggctggctggtccgctggaaacgccgaaacaacgtcggctttggggcccgccatgttcttgcgccttcattcccccctgagccacctcccccggggctcacatcccaggctcagctgcctctttccctaaaagacttctctccagaggacgtgtttggctgtgctgaattgcccttgctgtatcgggcagtgcccggcagctttggtgcatgtgatcaagtacaggtgctgctgtgtgccaacagcaggggcaccgagaagcggcgggtactgctgggtgggctccaggctgccccgagatgcttctttgggatccgcagtgaggctctgcctgcctcctaccacccggacctgggcatcccctggttagagtggttggcacagtttgaccgggacatgggacagcagggccgacaggtggctttgctgctggctgcccgagtggtggaggagctggcaggcctgcctgggctctaccacgtgaagctcttgcctctggccgcctctagcaccacgcctcccctgcccagctcagtggtccgggcctttaaggcccattaccgacaccggctgttgggcaaactggctgccatccaaagcgagagggatggcacctcgctggccgaggccggggcaggcatcaccgtgctggacgccctgcacgtggcgtctgccgcctgggccaaggtgcctcctcagctcattttcagcagcttcattcaagaagggctggctcccggcaaaacgcccccgtcctcgcacaaaacctctgagatgccaccagtccccggcgggctgagcctggaggagttttcccgctttgtggacctggagggtgaggagccaaggtctggagtatgtaaggaggagataggcactgaagacgagaagggggacagagagggtgcctttgagcccctgcccaccaaagctgatgccctccgggccctgggcaccttgaggaggtggtttgaatgcaacagcacttctcctgagctattcgaaaaattctacgactgtgaggaggaggtggagcggctttgctgcctatgaaggcgccttcactgcttgccagagccccttcctctcttgtttcccatggaaacggcctcttcagaaggcagatcgggctgtctctttcctgtggaaatagaactgtcgtaaaggtgtagaagggagagaagttgggacaccaagtctgagcttggagtggcagtcgtccaaaccccaggaagagagctctaaagatggggcttcgggggtaggaatccaggatgcttagtttctagaccctgcttgaaagttctagagcctttgaaagggagttagtctagaggcagccacttagaaaggtggaatttgggctttttggacagactgcttccttgaactttgtgttaaaaacagttctgcttctgaaaataaagtttttaatcagaaaa

SEQ ID NO: 191332 - DNA, 2472 bp, Homo sapiens
  Payload ID: 17793
  Gene Name: tigger transposable element derived 4
  Uniprot ID: Q8IY51
  ENST ID: ENST00000304337
  CDS Start-End: 822-2360
gggtaattttctggcagcgacctaatgcgcgcggggccagaggcaccggctagagctgggagcttgcggaagggcgcccctgcctggtcttgagaggtcgaaggtctccaggaggcctccgcctccctctttttcattcacacaccctagcctcacacgttaggaggacccccccaacagaccgtgagctggtgccgggagggtggaggtagatgtacctcacctccacgctaccacagaagagcgaaagctgctttctcagccaccggagagcacgaagaagaagaagatatactggcaagttctagaaggattctaccattttcttctttaccatgaacaaacttgaaaattaatgggtaatagttgcatgaaaacttttgaacgttttttcttatctctgaggccttctatggagaattaataggaggttgaatgtgtgcatggataaaatggatcatcttaaaggattgaagttccaaaaatacatcagcaggactggacaggttttatataatgagatttctattttagcttgacttctacaactctgaataagctataaactgagctatacaaggtactaggaaggaagtttctcttctaaaatattctagttgcatataatatttttcttcagatctttgaaaaagcatattttgtcatcaagttcctacaaaataagactattagacaccaacttttagtgtataaagtaggatagaaagcagcaatctatattatactggaaaacaaatttaattaaagaaacagtcaccaggaagttaagaagagtaatctctacataagcactggctgagatggcagaagcttctgtggatgcctcaactctgcctgtaacagtgaagaaaaagaaaagcctatccattgaggaaaagatcgacatcataaatgcagtggaaagtggcaagaaaaaagcagagattgctgctgaatatggaataaagaaaaattcattgtcttctattatgaagaataaagacaaagttctagaagcctttgaatctctaagatttgatccaaagagaaaaagactgagaactgctttttacacagatctggaagaggcattaatgagatggtatcgaattgctcagtgtctaaatgtaccagttaatggtccgatgttacgtctaaaagctaatgattttgcccagaaactgggccataatgattttaagtgcagtaatggttggctggatcgttttaaatccaggtatggtttagtattcagagctcaacctgtagaagctacaggtgtaccagtagacccttcgactgtctggtaccaaaatgtacttccttattatttaaatgattatcatcctaaaaatgtttttaatataaaagagactgggctgctttatcgaatgttacctaccaatacatttgcatttaaaggcgaaacatgttcagttggaaagttatgcaaagacagaataactctggtggttggcacaaacatggatggctcagagaaacttcctttgcttgtcattggaaaaaagagaactccacattgtttcaaaggtttaaaatcattgcctgtgtgttatgaagctaacagaatggcatggatgacctccgatgtatttgaacaatggatgcgaaagcttgatgaggaatttcaagcccagcaacgaagagtggtgatttttgttgagtcttttccagcacatccagaggtaaagaacctaaaatccattgagttagcattctttccatcatgtttatcttccaaatgtatagctatgaaacaaggtgttattaaaagccttaaaatcaaatatcgacactgtcttatcaagaaatttttaagctctgttgaaggtagcaaagaatttacattttcactactagatgcagttgatacattgcatctttgctggagggctgtaaccccagagactattgttaaaagctatgaagaggcaggattcaaatctcaaaagggagaaagtgacataacaaatgcagagaaggatactggtctggatttggttgctgatgctctgggggcaggagtagaatttcctgaaggtttatctatagaagaatatgctgccctggatgatgatttggagacatgtgaagcagcaccaaatggtgattccatatgcaccaaagaaagtaaatcggatgaaactggattttacacttctgatgaagaggatgatgatggatctccaggaactgaactccctttaccatcaaaatctgaggcaataactgctttagatactctgaaaaaatttctcagaagtcaagatatgaatgacggacttcaaaattctttagcagaccttgaaaattttattaactctttatcacctaagtaactatgtattgtacatctaaagagtaatagcttttcctgatacattttattatataaggtatgtaaaggagttgtaccacaccacttaaacataaaaaatggaaaactgctaa

SEQ ID NO: 191333 - DNA, 5390 bp, Homo sapiens
  Payload ID: 17794
  Gene Name: tigger transposable element derived 5
  Uniprot ID: Q53EQ6
  ENST ID: ENST00000321385
  CDS Start-End: 70-1998
gccccgccccgagcggctgggcgtgtggctcccgcgacccgcgcggcccgggtcccccccgccgcagccatgtaccccgcgggccccccggccggcccggtaccgcgccgcggccgccgtcccctgcccgggccccccgcgcccgccccagcccccgtccccgctgcacggccgccgccccccgcgcccgggccgcggccccgcgtggccgtgaagatggccttccgcaaggcctactccatcaaggacaagctgcaggccatcgagcgcgtcaagggcggcgagcggcaggccagtgtgtgccgcgacttcggcgtgccgggcgggacgctgcgcggctggctcaaggacgagcccaagctgcgctggttcctggagcagctgggcggtgaggtgggcactcagcgcaagaagatgcggctggccaacgaggaggagatcgaccgcgccgtgtacgcctggttcctggcgctgcgccagcacggggtgccgctgtctggcccgctcatccaggcgcaggccgaggccttcgcgcgccagatctacgggcccgagtgcaccttcaaggccagccacggctggttctggcgctggcagaagcgccacggcatctccagccagcgcttctacggcgaggccgggcccccagccccgagccccgcgcccggcccgcccgtcaaggaggagcccgcgctgccctccggcgccggccccctgcccgaccgcgccccggccccgccgcccccggccgagggcggctacggggacgagcagatttacagcgccagcgtcaccggcctctactggaagctgcttccggagcaggctgcgcccccgggcgcaggggaccccggggcggggggctgtggccggcgctggcggggcgaccgcgtaacggtgctgctggccgcaaacctgaccggcagccacaagctgaagccgctggtcatcgggcggctgccggacccgcccagcctgcgccaccacaaccaggacaagttcccggcctcctaccgctacagccccgacgcctggctcagccgcccgctgctgcggggctggttctttgaggaatttgtcccaggcgtcaaacgctacctgcgccgaagctgcctgcagcagaaggccgtgctgctggtggcccacccgccctgcccaagcccagctgccagtatgcccgccctggacagcgaggatgcccccgtgcggtgcaggccggagcccctcggtcccccggaggagctgcagacaccggatggcgctgtgcgggtgctgttcctgtccaaaggcagcagccgggcacatatccccgcaccgctggagcagggcgtggtggccgccttcaaacagctgtacaagcgcgagctgctgcgactggctgtgtcctgcgccagcggctccccgctggacttcatgcgcagcttcatgctcaaggacatgctctacctggctggcctctcctgggacctggtgcaggcgggcagcattgagcgctgctggctgctgggcctgcgggctgccttcgagccccggcccggcgaggacagtgctgggcagccggcccaggccgaggaagccgccgagcacagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccatggggggcggagaggacgaggaggaggccaccgactatggagggacctcagtgccgactgccggggaggccgtgcgggggctagaaacagctctgcggtggctggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtgagaggtcgccctgcctcactggcaccctgggggcacagctggaagagaggcctggcccatgctcctctcagggcaggcacatgtacggggcatacaaggcacagcgcctgttggaacaggtggctgtgttcctgctctggcccccgtggggctgggcctccgcccctgcaccagtcacatgcactggacgagggccgaaactcctgtctgctatcgagccctggtgctatgtggccccggagccacagcacaatcatctcagtggcgaagcacaccacttgattctatttttttttaacacattaaatctgtttttaaagatactcttcagaggggccgtgagaacaggggccgggtgggctggtctcgggccgccctgcggtttctctggaggtcagaggccccaggtactggagcatcactgtggagtgggaggggtggagccctgtattaggttctgggtgcagcagggaggtgtagagttccgtttccttggatttttagttttccctaagaaaactgaacagatctcttattccgtgggattggcagctgcctggctttgggccctggtgacttggccaacggcaggagagtttcccctgcttcctcatcagccacagaccattctgtccagtcccagggcctggagccacctgacttacctggaagcaggccctggcattagcccccagggcaatacgcagtgccaccctctgtgggctctcctccccaccctcagacttttctgcctctcctgggactgccaaggatgtggctgacaagctgctcctgggaggcctactttgaaaggaggaaagggccccagggcctgtcaaaccctggttctgttctgctctggccaggtctagacctacagtccttctggttggactggggccagggatgcccatgcctcctcaggtagggtgggaactgcctttgcagagatgctgcccgagctggtgtgaggggcagggagctggcctgcttgcctccaggtgttgacccctcgtccccatctgcccccagtgtcctcctaggagagggaaccttgaaaacccagagttgtggagtgcaggggtaggctggaggcctgcacggggaagggaagggctgtgcaccagcttggcagtggggcagctggagggtgtcccccaaaagtgacctttatacaggtccaggaacaaacagttccttggaactgcccgcaagtgaagaaatatatacatatatatgtatatatctatatctcaaaatctgagagctcagggaggccgtggaaatttggggaagaagaaacagactccctgagcagagctcagggcagcagctccaggcatgcctgctgagcccatcaggccaccgccacctgcaggaagagcctctggcctgaactgctggggatgggctgcagaaagcctgagacatttgggccagcaccttcccaggggcacaggcccccaaggcggggacaccacctctgctctgccaggcctgcctccagggctctgaggagaagctgacttcacggccgcggtgccagtgagggctgcatagccaggccttgtctgtagtctgggcggcccgtggcgctgcccttcagcccaactactcattgccgctgcgtctttggcgaggctttcatttccaacctttcttcccatctcagcccttttgttggcccgggtcccaggaggctggtgtcggtgagggcaggcccgctcctctcatcggggtggctgtggcctgtcccccagtccctcaatggccactttctataaacaaggcagcactaatttttgctataagataaaagaggccaggcacgttggctcacacctgtcatcccagcactttgggaggctgaggcgggtggatcacctgagattgggagttcgagaccagcctggccaacatggtgaaaaccccgtctctactaaaaatacaaaaattagctgggcgtggtggcaggtgcctgtaaccctagctactcaggaggctgaggcacgagaaatgcttgaagccagaaggcagagattgcagtgagccaagatcacaacaccgcgctccagtctgcgcgacagagcgagactctgtctcaaaaaaaaaaaaaaaaaagtgcaggtgcacgctggtggggacattaggagcctgtcaagagtgggtctgcctgctggcacttactagacgggaaataccccctaaagagggcttaaaaagcatcttctccctagcacggggcatgctggcacagggtgctgtgtgacagaggcttggccgctgggccccgctgctgagaaggctgctctgcccatgcctggccctgtgggcagtgccagccatggatccctgagaccctgggctggaacctggggccccgtcccagccctacctgcagctcactaaccctctctgggttctgctcagtgtctgaagtgatggaaagaccccagggttggtggctgtagcggcccccaggggtggcagaaccctttgggaggccaagtgttctttcccaaagctgcgcgggtgccatcgcctgccaggccctggctgtggtgacagacgtgggctggggtgaggctgcatctgcttcctctaacagccgtggctgcctgcgggctctggcctccgctctggcagattctgcacattccctgcaggcgcaggggtgggtgggggtgcctgtggcctcggaggtacagccagctgtcctcagctcagatggcccccaagagcccccagctcctgttcactgctcttccagttagtgacccccgtgtcagcatcattgtcagagttcctgggcttgtgggggctggagaagggaaggcgctgaggagggaaagatgagtgcaggttttgttgaaaccacccgacccgcgttttcagggggacgaggccactgccttggcccaaggacctgcaggcttgggggaccccctcgatgtccactgggctgcggatgaaacatcacactgtggtaggaaaggaaggggagcacccccagacgggggggtcctgcagagaccccaaccccttacctacctagttgagacacccatggggagcagccccaacagcatgtcggagtccctaggcttgtggggtcatgctctgttgagggcccttcctctaactggcgagcttgtttacagctgagctcgcctggtcagatgggcccagtggctttatctaataaaggctggacatgtccacttcatgagca

SEQ ID NO: 191334 - DNA, 5390 bp, Homo sapiens; identical to SEQ ID NO: 191333
  Payload ID: 17794
  Gene Name: tigger transposable element derived 5
  Uniprot ID: Q53EQ6
  ENST ID: ENST00000504548
  CDS Start-End: 70-1998

SEQ ID NO: 191335 - DNA, 4006 bp, Homo sapiens
  Payload ID: 17795
  Gene Name: tigger transposable element derived 6
  Uniprot ID: Q17RP2
  ENST ID: ENST00000296736
  CDS Start-End: 776-2341
gcaagctgcgccgctcacattcccggaggcgcttggcccggcggctggacgagggggatggctggcgcactcgcgctccccgctgtcggcgagaggcggctccagtcgtgacagcagcaacaaggaagtggaggcgagggctcgcgcgcgcatcccgggggctgaaggagccccggccccgcggccccgcccggcgacacacggcgcggagtcgcgacagcccctctcgcttcccctcctcggagtcgcgatatggggtcctgaagggcaagaataggagcacaggttcgctccgcaggctcctcaccgatgcctgccgagggccccgggggtcaagccccggggagctcgaggaagacggcagggacacggtcgtcaccgaggcaccggtttggcggctgcaccggcagtagcggcacaccacggatcgccagggagacccgtcccggcggccctcgcggcgcaccggaagcggtcggcagcgcgtgactgcatgcgacccctggcgcaagcgcaacagcccagccctagcttgggagcggacccacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttcgtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaattaataagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaattaaaa

SEQ ID NO: 191336 - DNA, 2429 bp, Homo sapiens
  Payload ID: 17795
  Gene Name: tigger transposable element derived 6
  Uniprot ID: Q17RP2
  ENST ID: ENST00000515406
  CDS Start-End: 809-2374
gcaacagcccagccctagcttgggagcggacccacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcaggtaacaggggcggggctgtgctgagcgtgagggatctaggccccgcctcacctttcagagccacgtcgggcgctgggaagcctacaataccaccctctcctcagcacgacgttcaaggcctgacctcagcctgtctcagtctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctacaatccattctccacgaagcagtcagattgatcattttgcactctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagata

SEQ ID NO: 191337 - DNA, 3612 bp, Homo sapiens
  Payload ID: 17796
  Gene Name: tigger transposable element derived 7
  Uniprot ID: Q6NT04
  ENST ID: ENST00000396862
  CDS Start-End: 1830-3479
acctcggccagcttggcttccgtggaggccgctcctcgctttctgaggctcaaacgcaagccaccgcccgaaaggccgccgatctgaggagcgcaaccgccagcccaccgctggcctaccgcagccctgtccaggtacagagccagagcgccggccggaagtggaagtgacgctttccgagggtggcgcaggcccgccctctggctaaggcgcctgagcccggcctacttcctcgccagagaaactgctgtcttccccggcggtagggaagggttaatgccaccgagtatccagacccgctgaagcctagagggccttgtaccggctcaccgcgtggctgtcgctgtctcgtgtccccagtgggggaggcgtcgcactgccgcgtctgttctgcgtggctgtcgggcggcgtttggtcccgggagcctcgccggcacctggaatggataaaagtggcagtttttgtttcttcccatgaggttgtgtatctggactgagaaccaggaaattaatctagactaagacatttctaaggacctggaatggctttggggagcaccaggaggacccgaaaagagtatttgagggcctagagggacagaagagtttgccagtaggatttatgagaaacaattgatcagaaacagcagcagagaaaccttttagatttcttctgtggaaaagttgagtcttggttcaaattaagtaaaataaacactgaagagaaatcaaaatctcaaatataaaaagtatgttacttatagtgtaaatttaggaaaacaaatgaaaggacagatctttaaaaatttttaactatggtgaaatatttgtaaaacttttgggctcatctctgagaattgctgtgattctgaaacttgataatatctcaaatagagaacagtttcagtgaaaaatagcacttgagaataaatcagatgttcccaagaaagaagatctgagaatggtaaagtgccactgacaaataaattatttacatacttacatattaccttggcaaacacaagagacattcaagttaaagcacggtgcttgacaatactatattgaatgcaataaaagttggatttcattcatatgtacaacaaactactttcttcttcacttcaagattcggtacaactgttcctgaattccaactctccatacatcccaatgtcagggtccctgtagctcggagcccttatccaggtagatgaactgctgcccagtgaacactatgtacaaagcaatttgagcaccattctcttttctggcagtgaggtaaaatcaggtctttttggaaggggagaagccacattgcatctctgctacacacaagattactctgtcattgcctttgagtctttcacgctcccttcttctgaagcatcagtttttatggaaacttatcacacctgtcttgtgggcacatcttgctccatccctcctctcttcatattgtccgttttccggtattgagttagggaaagtatgcaggtattcctgtcattcctgactgaggctgttgtatctgtcaaaagagaggagaggtagggggcattctgaaaaatgatcactcatggcttgcaggagcaagagccagacaggactttgcaactggcagctttctgagtgcataagacctccacctctagactagctcttcagtcatggttagccccttcagtccattatcctccaatacaatgcccatgccttctggggctttcagctaagttttgtttaaaaaatgtgggttttttttttgccaattcattaaggcttttccctttgttttctcctgttggtggttcagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcgaacagatttcaaagctagcactggttggctttttagatttcgaaatcggcatgcaattgggaaccgaaaaggatgtggggaacaagtcctaagttcagtttctgaaaatgttgagccatttcgacaaaaactgtccatgataatcaaagaggagaaactgtgtctagctcagctatacagtggggatgaaacagacctcttttggaagtcaatgccagaaaattctcaggcaagtaggaaagatatctgcctaccagggaagaaaataaacaaagaaaggttgtctgcctttttatgtgcaaatgcagacggaactcataaattaaagtcaatcattattggaaaatcaaaactgcccaaaagtgtgaaagaggacacaagtacattgcctgtgatatataaacccagtaaagatgtttggttcaccagagaattgttttcagaatggttttttcaaaactttgttcctgaggtccgacattttcaacttaatgttctaagatttcatgacgaggacgtcagggcattgttacttctggacagttgcccggctcatccttcctctgaatccctaaccagtgaggatggtcgaataaaatgtatgttcttcccccataacacttcaaccttgattcaaccaatgaatcaaggtgtgatcttgagctgcaaacggctgtatagatggaagcaacttgaagagagtcttgtaatatttgaagaaagtgatgatgagcaagagaaaggagataaaggagtttccaaaattaaaatctacaatataaaaagtgcaatttttaactgggcaaaaagttgggaagaagtaaaacaaataaccatagcaaatgcatgggaaaatcttctttacaaaaaggaacctgaatatgattttcaaggcttagaacatggggattatagagaaattcttgaaaaatgtggggagttggaaactaagttggatgatgatagggtgtggttaaatggagatgaagaaaagggttgtctcctaaaaaccaaaggtggaataacaaaggaagttgttcaaaaaggaggagaagctgagaagcagactgctgaatttaaattatctgctgtaagagagagtttggactaccttcttgactttgttgatgccacacctgagtttcagagattccacttcacactgaaagagatgcaacaagaaatagtcaagaaacagttccagagtaaaatccattctagaattggtagctttttgaaacctaggcctcataatattaaggactccttcagtgggccttcaacttctggttctaatcattagattttgtgtttaaagatttctgccattatatgatgtaggccagctgtgaattgtcttgttttagcaactgacattattttgtatatcagtgcccatttatataatggttataaaatttacagtttgaaaataa

SEQ ID NO: 191338 - DNA, 555 bp, Homo sapiens
  Payload ID: 17796
  Gene Name: tigger transposable element derived 7
  ENST ID: ENST00000573608
  CDS Start-End: 208-555
cggccgccgccgctccagcggctccagggtcgaagccataggggaagccgcttctcggttacctcggccagcttggcttccgtggaggccgctcctcgctttctgaggctcaaacgcaagccaccgcccgaaaggccgccgatctgaggagcgcaaccgccagcccaccgctggcctaccgcagccctgtccagagttaaattcagtatgaataagagagggaaatatacaacactgaatttggaggagaaaatgaaggttctaagtagaattgaagctggacgatcacttaaaagtgtaatggatgaatttggaatcagtaagtcaacattttatgacattaaaaaaaataagaagttaattctggactttgtactgaagcaggacatgccattagtaggggctgagaagagaaagaggacaacgggagccaaatatggtgatgtagatgatgcggtctacatgtggtaccaacagaaacgctcagccggtgttccggtaagaggcgtggagcttcaggctgctgcagagagatttgcacggtgttttgggcga

SEQ ID NO: 191339 - DNA, 2720 bp, Homo sapiens
  Payload ID: 17797
  Gene Name: tight junction associated protein 1 (peripheral)
  Uniprot ID: Q5JTD0
  ENST ID: ENST00000259751
  CDS Start-End: 379-2022
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgtccagagtccttctggccacatctctgagcctgcctccttcttgcttctcagcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 191340 - DNA, 2778 bp, Homo sapiens
  Payload ID: 17797
  Gene Name: tight junction associated protein 1 (peripheral)
  Uniprot ID: Q5JTD0
  ENST ID: ENST00000372444
  CDS Start-End: 434-2077
agatgacgcgacacgccaagtgcgtggggattcccgcggccctggccactacccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggtacctgctgtcactgactcctgaattcattctcgctgtgtgtctacttttgcttttttggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 191341 - DNA, 2751 bp, Homo sapiens
  Payload ID: 17797
  Gene Name: tight junction associated protein 1 (peripheral)
  Uniprot ID: Q5JTD0
  ENST ID: ENST00000372445
  CDS Start-End: 377-2050
agatgacgcgacacgccaagtgcgtggggattcccgcggccctggccactacccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 191342 - DNA, 2695 bp, Homo sapiens
  Payload ID: 17797
  Gene Name: tight junction associated protein 1 (peripheral)
  Uniprot ID: Q5JTD0
  ENST ID: ENST00000372449
  CDS Start-End: 324-1997
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 191343 - DNA, 2665 bp, Homo sapiens
  Payload ID: 17797
  Gene Name: tight junction associated protein 1 (peripheral)
  Uniprot ID: Q5JTD0
  ENST ID: ENST00000372452
  CDS Start-End: 324-1967
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 191344 - DNA, 581 bp, Homo sapiens
  Payload ID: 17797
  Gene Name: tight junction associated protein 1 (peripheral)
  ENST ID: ENST00000372454
  CDS Start-End: 281-581
cactacccggcctgccccgcggcaagatggcggcctgaacgcagctggcagcggcggaaactgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaaca

SEQ ID NO: 191345 - DNA, 909 bp, Homo sapiens
  Payload ID: 17797
  Gene Name: tight junction associated protein 1 (peripheral)
  ENST ID: ENST00000442878
  CDS Start-End: 331-909
acccggcctgccccgcggcaagatggcggcctgaacgcagctggcagcggcggaaagtttgcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgat

SEQ ID NO: 191346 - DNA, 3268 bp, Homo sapiens
  Payload ID: 17797
  Gene Name: tight junction associated protein 1 (peripheral)
  ENST ID: ENST00000454762
  CDS Start-End: 1-718
gctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttctttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgcctggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggt

SEQ ID NO: 191347 - DNA, 2572 bp, Homo sapiens
  Payload ID: 17797
  Gene Name: tight junction associated protein 1 (peripheral)
  Uniprot ID: Q5JTD0
  ENST ID: ENST00000436109
  CDS Start-End: 228-1871
agatgacgcgacacgccaagtgcgtggggattcccgcggccctggccactacccggcctgccccgcggcaagatggcggcctgaacgcagctggcagcggcggaaagagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 191348 - DNA, 2716 bp, Homo sapiens
  Payload ID: 17797
  Gene Name: tight junction associated protein 1 (peripheral)
  Uniprot ID: Q5JTD0
  ENST ID: ENST00000438588
  CDS Start-End: 342-2015
agctttcagagtcctggtgcagcctggcagcagtgtttggggaacaggcgagatagaggagctgagccccttctccaacagccgtcctctctttctgttgaccaaccagagaggctttttgcctgaggtcagcaagctggcctccctggttggcagggggagtgcttggcttccatctggcatggtttccggatgggagaaagcccctgagggtctggtggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatg

SEQ ID NO: 191349 - DNA, 4312 bp, Homo sapiens
  Payload ID: 17797
  Gene Name: tight junction associated protein 1 (peripheral)
  Uniprot ID: Q5JTD0
  ENST ID: ENST00000612912
  CDS Start-End: 1015-1146
ggcattacacagggccccacagtgtcagtgctgagcctggagcccaggtgtctccaactcccccgactggggttttcttcacgagtgttcctcagccttggcactctggatattttctattgggaatcatttgtggtgggagttgccctatggttgtgggatgaccaaagcatccccggcttctacccactaggtgccagtggcactccttccctccaggtttcgacaaccaaaaatgtctccagacacttgccagacgtccctggggaaggagagtgggcgccagacgtccctggggaaggagggtggacagagttgcctggttgagagctactgctctgtgttgctcccttttcagatttcttctcctagccctatgcctcctcattgcaaaggccggtgaccatcattatacaccaaatagccttgggcctccttctggaaatgctaggtgctctctttccatcattttctctatcttcttggatctctgtgaggctttttcctggtgttctcatttgtaacccatgttccccaaatctcttagttgtttccaaactctgagaggcttgggagatgaggaccgatgtggagtagggacaggacggaaccggacctattccagaattgggcaatgtgctgagaccatgaacacacagacacatgtatctcatctgggcctgtgacagtactgtcatggagaaaggcaggaacccagtgcttccagtcatctgcctccagccgctttcccctcaggccctctgtttcatggccttcctgccgtggttctccctggggggccttccaggtcccagactgggcagcaggcctgtagcactgacagacaggcggctgacacctggtttccactttcttcccttctctggtttcaggagctgtggctaaaggaagtggaggggccgtgggatgcggagagccgagggctaactcccggacagcggaacagagagagctgccgacaaacagacggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagtgagtatctgctacctgagatactgccctgcctcaactctgtccctcttagctccaggctagactgttggtacagttggactttcccttggattaggtagaaataaaggttgggatgggttgttttagggactctgggaggagtgttgatgttgtggatattttttctggaaaatgggattttattgttccatgggcttcaagagagcgtagaatcaggaggcgaatggctctgagggccctgctcttcttgctaaggagcccttccccagctcctggctcctgtaccagctgccacccttacagccctttagccacatgaggcctctggagaggagggcagtgctgggctggatttccaagagatgaataatggagaagcctgattgtgcagtggggaaactggagctgggggcttggtggccagctgacatgggctgtaaccagagacaggctgggagccatatccctacccccaattctttatttctattctccgatagtgaagggaggctggactgtcccctaccatcccctcttcctcccctgaccctccaacccaggctgtgttcccagggccagcaggcctatgaaatatgctgccttagactcagactaagactccaggagtttccctgtcctgtttgcctgtcctcatgtcatcccttccttcctgagcccactctggagctccagggcatgcccttctatctctcatacccctctgcccttgatcccacaacaccctgccaggctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttctttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgcctggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggcctggcccccactcccaaccttggctctagactgttactcttaagctttgagaaattttcacattgatgactattttaaaatcaaataaaactattttactggt

SEQ ID NO: 191350 - DNA, 7950 bp, Homo sapiens
  Payload ID: 17798
  Gene Name: tight junction protein 1
  Uniprot ID: Q07157
  ENST ID: ENST00000346128
  CDS Start-End: 476-5722
cgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 191351 - DNA, 6747 bp, Homo sapiens
  Payload ID: 17798
  Gene Name: tight junction protein 1
  ENST ID: ENST00000356107
  CDS Start-End: 1-5307
atgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaat

SEQ ID NO: 191352 - DNA, 1032 bp, Homo sapiens
  Payload ID: 17798
  Gene Name: tight junction protein 1
  ENST ID: ENST00000400007
  CDS Start-End: 1-682
aaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttcc

SEQ ID NO: 191353 - DNA, 6764 bp, Homo sapiens
  Payload ID: 17798
  Gene Name: tight junction protein 1
  ENST ID: ENST00000400011
  CDS Start-End: 243-5321
gtagtttcgatctgatgtcactccctgcggtatgcgcacgccagcgataaggctttgagactgcaaaacactccactcagcctgtgaggcgtagtaggtcgggttttctttcatgctgtattacttatttaaggaggaaaggctttgtttccgtattacacagaatgtcactttgttcctgaagtgtgatctctggtacttaatatgcaagacaacacactttttaagaggttatttcaagtatggagagaaatacgttttcaatggattgccacagtaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaa

SEQ ID NO: 191354 - DNA, 5007 bp, Homo sapiens
  Payload ID: 17798
  Gene Name: tight junction protein 1
  Uniprot ID: Q07157
  ENST ID: ENST00000545208
  CDS Start-End: 1-5007
atgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaa

SEQ ID NO: 191355 - DNA, 2890 bp, Homo sapiens
  Payload ID: 17798
  Gene Name: tight junction protein 1
  ENST ID: ENST00000495972
  CDS Start-End: 475-1626
gggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagagtcacacgtacatttgagaatctgaagaaaattatgatccttctctccagaaaaatgtgcatgtgcacatacacgcagcaattgcatacaatttctggagactcccaaggctctataggccaccacctgacccatggttaactgcagtccacatgaagatcacttgaaacatgagtccagggctgaagagacagtttagaagaaaagggaacccttatacgttgttgatgagaatgtaattgatacggccattctggaaaacagtatggaggttcctcaaaaaattaaaaccagaacgaactagcacatgatccagcaattccacttctgggtacatatccaaaggaaatgaaatcactgtctcgaagagatatctgcactctcatgtttgttgcagcattattcacaatagccaaggtatggagtcaacctgaatgtcgaacacatgaatggataaagaaaatgttcacacacacaatgaaatgtgatttagcctttaaaaagaaggaaatcctgccatttggaacaacatggatgaacctggagggcattgtgctaagtgaaataaaccagacacagaaagacaaacactgcatgacctcacttactgtggaacctaagcaagttgaactcatagaaacagacagtagaatggtggttaccaggggttaggggtggggaggaatggggagatgtttgttaaagggtacacagtttcaattataagatgagtaagttctggagacctaatttacagtgtagtgacaagagttaataacgtatacttgaaatttgctaagagagtagatcttaaggcattcttttgacacacactaagaaaagtaactatgaggtatggatatgttaattaacttggtctcggtcatcatttgaatatgtatatcaaaacatcactgttgtacacctttaatagatacaatgtttatttgtcaattggacctcagtaaagctggaaagaaaaagtaaatttgggtctagatctgaagagatgatttaggattagagatgttgaattgagacttaacttgcatagaggtgttagctgaagccatagaagtcactaaaattgctaagagaaacagtttggaaagaaggcagagaactggataacagggagcacgttcttttaggaaggtgaagaggcgagggagaagtaagaaaagggaggcgtacctagccaggagagagcttttttaaagtttgtaaaaaaccgcagtgacagtggtagttaaaactgtaaagtgtttcgcattctactaaaatgggaactagtaagagaagaggataacttgtaagagctatgaatgtggttgctaattcgtatctactgtagtttttatgtatttgtgaagctgattatttctaaatttcaaacctagattta

SEQ ID NO: 191356 - DNA, 720 bp, Homo sapiens
  Payload ID: 17798
  Gene Name: tight junction protein 1
  ENST ID: ENST00000558447
  CDS Start-End: 27-720
ggcggcggatggcccagagctgatctatgcggcgcctggaggggctgtgtctgcggcggcggcggaggcggcggggccctgcccgcgagcggagcggggacaagatgaagtaccagaaatacctgacggtgctgcagatggccatcggcgtcaccccctccaaccgcggcagcctcctgccgctcaagaggaagctgtgggtaacgccatcctctgaaaatcctaatggtgctacttctagtgtcagccaaggaaaaccctctttaagacgaattaaagggagattacacagaagcaaaagccttgatagcatggatttctgtgagctcactagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatc

SEQ ID NO: 191357 - DNA, 6990 bp, Homo sapiens
  Payload ID: 17798
  Gene Name: tight junction protein 1
  ENST ID: ENST00000613680
  CDS Start-End: 524-5554
cccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcctttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaacttttt

SEQ ID NO: 191358 - DNA, 6757 bp, Homo sapiens
  Payload ID: 17798
  Gene Name: tight junction protein 1
  ENST ID: ENST00000612628
  CDS Start-End: 243-5321
gtagtttcgatctgatgtcactccctgcggtatgcgcacgccagcgataaggctttgagactgcaaaacactccactcagcctgtgaggcgtagtaggtcgggttttctttcatgctgtattacttatttaaggaggaaaggctttgtttccgtattacacagaatgtcactttgttcctgaagtgtgatctctggtacttaatatgcaagacaacacactttttaagaggttatttcaagtatggagagaaatacgttttcaatggattgccacagtaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaacttttt

SEQ ID NO: 191359 - DNA, 6977 bp, Homo sapiens
  Payload ID: 17798
  Gene Name: tight junction protein 1
  ENST ID: ENST00000614355
  CDS Start-End: 512-5542
cgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaacttttt

SEQ ID NO: 191360 - DNA, 7230 bp, Homo sapiens
  Payload ID: 17798
  Gene Name: tight junction protein 1
  Uniprot ID: Q07157
  ENST ID: ENST00000621049
  CDS Start-End: 488-5794
cccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcctttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgctgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttcttttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaacttttt

SEQ ID NO: 191361 - DNA, 1636 bp, Homo sapiens
  Payload ID: 17798
  Gene Name: tight junction protein 1
  ENST ID: ENST00000631203
  CDS Start-End: 488-1636
cccccgccgggccgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcctttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagagtcacacgtacatttgagaatctgaagaaaattatgatccttctctccagaaaaatgtgcatgtgcacatacacgcagcaattgcatacaatttctggagactcccaaggctctataggccaccacctgacccatggt

SEQ ID NO: 191362 - DNA, 3725 bp, Homo sapiens
  Payload ID: 17799
  Gene Name: tight junction protein 2
  Uniprot ID: Q9UDY2
  ENST ID: ENST00000265384
  CDS Start-End: 80-3061
tgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaaaaaaaa

SEQ ID NO: 191363 - DNA, 4058 bp, Homo sapiens
  Payload ID: 17799
  Gene Name: tight junction protein 2
  Uniprot ID: Q9UDY2
  ENST ID: ENST00000348208
  CDS Start-End: 97-3228
agagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 191364 - DNA, 4611 bp, Homo sapiens
  Payload ID: 17799
  Gene Name: tight junction protein 2
  Uniprot ID: Q9UDY2
  ENST ID: ENST00000377245
  CDS Start-End: 209-3781
gcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 191365 - DNA, 588 bp, Homo sapiens
  Payload ID: 17799
  Gene Name: tight junction protein 2
  ENST ID: ENST00000377259
  CDS Start-End: 136-441
tccagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttcc

SEQ ID NO: 191366 - DNA, 4129 bp, Homo sapiens
  Payload ID: 17799
  Gene Name: tight junction protein 2
  Uniprot ID: Q9UDY2
  ENST ID: ENST00000453658
  CDS Start-End: 233-3295
caccctctccgcctttcccgacaccccaaagtagcgctgcgagcagctgcgtctccctcccggggctcgcgcgcccagaaccctccggtctcaaggaagcagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 191367 - DNA, 614 bp, Homo sapiens
  Payload ID: 17799
  Gene Name: tight junction protein 2
  ENST ID: ENST00000423935
  CDS Start-End: 132-614
gggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcc

SEQ ID NO: 191368 - DNA, 4500 bp, Homo sapiens
  Payload ID: 17799
  Gene Name: tight junction protein 2
  Uniprot ID: Q9UDY2
  ENST ID: ENST00000539225
  CDS Start-End: 1-3666
atgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 191369 - DNA, 4459 bp, Homo sapiens
  Payload ID: 17799
  Gene Name: tight junction protein 2
  Uniprot ID: Q9UDY2
  ENST ID: ENST00000535702
  CDS Start-End: 152-3625
atatggatgtgtcactgtgtgagatgacaacaggatttgctggaaatgtgggccactattgtatccgccttacgtaaccacatggagtgatggaaatgggtgagcagcccggaatgtaggcggtggcctggcccatgcatctccagagaccatgaagactgctcaagccctacataggatgtggatccaggctgttaaaaagttgaggagatggaaaggccgtgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaatttt

SEQ ID NO: 191370 - DNA, 591 bp, Homo sapiens
  Payload ID: 17799
  Gene Name: tight junction protein 2
  ENST ID: ENST00000606364
  CDS Start-End: 189-591
agctgcgtctccctcccggggctcgcgcgcccagaaccctccggtctcaaggaagcagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgaga

SEQ ID NO: 191371 - DNA, 3350 bp, Homo sapiens
  Payload ID: 17800
  Gene Name: tight junction protein 3
  Uniprot ID: O95049
  ENST ID: ENST00000541714
  CDS Start-End: 463-3222
agatgcaagaagcaggagggagggggactccgggagtgcggtccattcatgtctgaatgtagccaacgagggtttcctaagcacctaccatgtgcggacgcttgataccagggcctcggcggtgagggcacaggcaggagcaagctcacctctgggcaagcaggggttaaggccagttgctcccacgtgagggcaccttgcgacagagccacacacccagtcctcctgctggcccgcccctcaccctggtccgtctccctgtgtctgtggtcgtcagttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacagc

SEQ ID NO: 191372 - DNA, 2897 bp, Homo sapiens
  Payload ID: 17800
  Gene Name: tight junction protein 3
  Uniprot ID: O95049
  ENST ID: ENST00000539908
  CDS Start-End: 120-2771
caggcacccgggccctggcacctgctgcctgcccagaggccacccagcctcctagacaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcaca

SEQ ID NO: 191373 - DNA, 680 bp, Homo sapiens
  Payload ID: 17800
  Gene Name: tight junction protein 3
  ENST ID: ENST00000586032
  CDS Start-End: 1-178
cctctacgcacaagcccagaagctgcgaaaacacagcagccacctcttcacaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacagca

SEQ ID NO: 191374 - DNA, 3068 bp, Homo sapiens
  Payload ID: 17800
  Gene Name: tight junction protein 3
  Uniprot ID: O95049
  ENST ID: ENST00000589378
  CDS Start-End: 157-2943
agccgggagctgcggagctggagggaggaggacgagagcccggccctcagcccgctgtgactctcctcagccccctcccccagcccggggtgggggccgattgactgtttccaggaccccctcgggtaggggggctggagagcccccaggtggaccatggcggtgagattccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcac

SEQ ID NO: 191375 - DNA, 2946 bp, Homo sapiens
  Payload ID: 17800
  Gene Name: tight junction protein 3
  Uniprot ID: O95049
  ENST ID: ENST00000587686
  CDS Start-End: 1-2817
atgaacctgtgtggcctcatgcccatcttccccgctcccctcgaccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacagca

SEQ ID NO: 191376 - DNA, 580 bp, Homo sapiens
  Payload ID: 17800
  Gene Name: tight junction protein 3
  ENST ID: ENST00000590545
  CDS Start-End: 210-580
tctccctgtgtctgtggtcgtcagttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaagcagctcttccttcccctcatcctctctcaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatga

SEQ ID NO: 191377 - DNA, 4376 bp, Homo sapiens
  Payload ID: 17801
  Gene Name: timeless circadian clock
  Uniprot ID: Q9UNS1
  ENST ID: ENST00000229201
  CDS Start-End: 156-3779
gaccggtccagctgagcctggtggcggaaaggctgcggccccgcgccagagggccggtggctcctccgggcttctgaggacccgcagggagcgggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacatatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctc

SEQ ID NO: 191378 - DNA, 5121 bp, Homo sapiens
  Payload ID: 17801
  Gene Name: timeless circadian clock
  Uniprot ID: Q9UNS1
  ENST ID: ENST00000553532
  CDS Start-End: 152-3778
ggtccagctgagcctggtggcggaaaggctgcggccccgcgccagagggccggtggctcctccgggcttctgaggacccgcagggagcgggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacatatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttgga

SEQ ID NO: 191379 - DNA, 1744 bp, Homo sapiens
  Payload ID: 17802
  Gene Name: TIMELESS interacting protein
  Uniprot ID: Q9BVW5
  ENST ID: ENST00000261881
  CDS Start-End: 87-992
ggagttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagttgggaggttttgtttctgttttttactgctccttgcaaagcagggctaatccatggacagtgtgcccagagtagtctagttgaagttttttgttttgttttgttttgttttttttgacacagagtctcactctgttggccaggctggagtgcagtggcacagtcttggctcactgcaacctctgcctcctgggctcaagcaattctcctgccttagcctcccgagtagctgggactacaggcgtgtgccaccacgcttggctaatttttgtacttttagtagagatgaggtttcaccatgttggccaggctggtctcaaactcctaacctcaggtaatccgcccccctcggcctcccaaagtgctgggattacaggtgtgagccaccgcgcccagcctgggtgaagttttgagatgtacatatatactgaatattaatgtcaattttttaaaagaagtaaaaa

SEQ ID NO: 191380 - DNA, 1459 bp, Homo sapiens
  Payload ID: 17802
  Gene Name: TIMELESS interacting protein
  ENST ID: ENST00000566524
  CDS Start-End: 56-280
agtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagttgggaggttttgtttctgttttttactgctccttgcaaagcagggctaatccatggacagtgtgcccagagtagtctagttgaagttttttgttttgttttgttttgttttttttgacacagagtctcactctgttggccaggctggagtgcagtggcacagtcttggctcactgcaacctctgcctcctgggctcaagcaattctcctgccttagcctcccgagtagctgggactacaggcgtgtgccaccacgcttggctaatttttgtacttttagtagaga

SEQ ID NO: 191381 - DNA, 495 bp, Homo sapiens
  Payload ID: 17802
  Gene Name: TIMELESS interacting protein
  ENST ID: ENST00000568216
  CDS Start-End: 72-495
gccctctgtcgccccgaggcaagcaggtggacccagctgagaagaagtctgtgtcgctgtgtgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcaggtaagtgttgaga

SEQ ID NO: 191382 - DNA, 1009 bp, Homo sapiens
  Payload ID: 17802
  Gene Name: TIMELESS interacting protein
  ENST ID: ENST00000562124
  CDS Start-End: 127-1009
ggacgccgtggcgccctctgtcgccccgaggcaagcaggtggacccagctgagaagaagtctgtgtcgctgtgtggtgagctctccaggccaggtgccgcgcggcctccacctctgcgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatcca

SEQ ID NO: 191383 - DNA, 685 bp, Homo sapiens
  Payload ID: 17802
  Gene Name: TIMELESS interacting protein
  ENST ID: ENST00000570251
  CDS Start-End: 336-685
gcctgggggcggggtccgtcgcggacgccgtggcgccctctgtcgccccgaggcaagcaggtggacccagctgagaagaagtctgtgtcgctgtgtggtgagctctccaggccaggtgccgcgcggcctccacctctgcggtaaccggcctgcccccgacccctgtccccaagccgagccgtgttgacgaaaatgaaataacaaaataaataaggaaaaggaccccttcctgtgtccagaggagaggcagcgtggggaataggaaacttgtcgagaggctcctttgagcccaacaaactgacgcatataaattttgtttgtttaatgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcgtgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaa

SEQ ID NO: 191384 - DNA, 892 bp, Homo sapiens
  Payload ID: 17803
  Gene Name: TIMP metallopeptidase inhibitor 1
  Uniprot ID: P01033
  ENST ID: ENST00000218388
  CDS Start-End: 171-794
ttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 191385 - DNA, 626 bp, Homo sapiens
  Payload ID: 17803
  Gene Name: TIMP metallopeptidase inhibitor 1
  ENST ID: ENST00000377017
  CDS Start-End: 97-528
tccagcgcccagagagacaccagagtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 191386 - DNA, 341 bp, Homo sapiens
  Payload ID: 17803
  Gene Name: TIMP metallopeptidase inhibitor 1
  ENST ID: ENST00000441738
  CDS Start-End: 55-341
gagctgggctgcagcttgggtgctggccaccaggcccgtgcactcccgtgccagatgcctgtctactcagcttggcctgcggaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgt

SEQ ID NO: 191387 - DNA, 1095 bp, Homo sapiens
  Payload ID: 17803
  Gene Name: TIMP metallopeptidase inhibitor 1
  ENST ID: ENST00000456754
  CDS Start-End: 76-486
atttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatccca

SEQ ID NO: 191388 - DNA, 595 bp, Homo sapiens
  Payload ID: 17803
  Gene Name: TIMP metallopeptidase inhibitor 1
  ENST ID: ENST00000445623
  CDS Start-End: 1-497
gtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagca

SEQ ID NO: 191389 - DNA, 3652 bp, Homo sapiens
  Payload ID: 17804
  Gene Name: TIMP metallopeptidase inhibitor 2
  Uniprot ID: P16035
  ENST ID: ENST00000262768
  CDS Start-End: 300-962
agcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 191390 - DNA, 3415 bp, Homo sapiens
  Payload ID: 17804
  Gene Name: TIMP metallopeptidase inhibitor 2
  ENST ID: ENST00000536189
  CDS Start-End: 294-725
gcatttgaggggggacgtaattcagcccatacaccaggctgccttctcttattcccagtcaccctttccgtgctcaaccaacttgggataaacaacccaggacatcccagggtagggtcccggaacaaatcccacagggacgacagcggcctgtctattctccagtgttcgattctcctcgaagcgatgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 191391 - DNA, 2433 bp, Homo sapiens
  Payload ID: 17804
  Gene Name: TIMP metallopeptidase inhibitor 2
  ENST ID: ENST00000592761
  CDS Start-End: 319-648
gtggaaggaggaggaggaggctgggcatcatctctcagcctggaggaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccggcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaatacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaa

SEQ ID NO: 191392 - DNA, 3345 bp, Homo sapiens
  Payload ID: 17804
  Gene Name: TIMP metallopeptidase inhibitor 2
  ENST ID: ENST00000585421
  CDS Start-End: 224-655
cttgttgaagaatcgtggaaggaggaggaggaggctgggcatcatctctcagcctggaggaggagacgccatgccgggggctgggatcaccatgccccttgcccgtctcgcaccttgctgcttgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 191393 - DNA, 3389 bp, Homo sapiens
  Payload ID: 17804
  Gene Name: TIMP metallopeptidase inhibitor 2
  ENST ID: ENST00000586057
  CDS Start-End: 272-703
ggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaag

SEQ ID NO: 191394 - DNA, 4603 bp, Homo sapiens
  Payload ID: 17805
  Gene Name: TIMP metallopeptidase inhibitor 3
  Uniprot ID: P35625
  ENST ID: ENST00000266085
  CDS Start-End: 302-937
gcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaca

SEQ ID NO: 191395 - DNA, 1650 bp, Homo sapiens
  Payload ID: 17806
  Gene Name: TIMP metallopeptidase inhibitor 4
  Uniprot ID: Q99727
  ENST ID: ENST00000287814
  CDS Start-End: 512-1186
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgta

SEQ ID NO: 191396 - DNA, 3913 bp, Homo sapiens
  Payload ID: 17807
  Gene Name: tissue factor pathway inhibitor (lipoprotein-associated coagulation inhibitor)
  Uniprot ID: P10646
  ENST ID: ENST00000233156
  CDS Start-End: 296-1210
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatg

SEQ ID NO: 191397 - DNA, 1088 bp, Homo sapiens
  Payload ID: 17807
  Gene Name: tissue factor pathway inhibitor (lipoprotein-associated coagulation inhibitor)
  Uniprot ID: P10646
  ENST ID: ENST00000339091
  CDS Start-End: 242-997
aacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgca

SEQ ID NO: 191398 - DNA, 3649 bp, Homo sapiens
  Payload ID: 17807
  Gene Name: tissue factor pathway inhibitor (lipoprotein-associated coagulation inhibitor)
  Uniprot ID: P10646
  ENST ID: ENST00000392365
  CDS Start-End: 29-943
gcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtgaagtcagggtacagctgatgccagctacagaatcactatgtttcaatatggaatatgaaaagtcctaacacataattgcaaatcattttctactatggtatacaaattttatcattacaaaatagtatcagcttttttcacttaaggaaaataatacatcttcattcaaatattcagtgcataaataattgccttaaattgagtctttgctgtggaatttgagagttttggaaatcaaaggcccttgtgaaacatttcctgttgccatttatttatagatagcaatagcttcaaatgagtgggaaagtctacttaggtgaagtggtaaatagtcactaagattgtataaatagcgcattgatgagttgcctaattgttttctccaacaataaccactggtccattggttcactacttactcaagaaagacatatactgagatggcttgaaatgtttaatgcatgtgaacgttatttttaccgtgttttggaaaaagatcttgatgttattgtcttcctttattttccacaattaagtgcatctaactgtgaattgtatatggaattacattattcagcatatacatatatttacctgctttgttcattctctgtattcaaaattaacagatcatgctgaaaaccactcaaacgattatattttttacattataagaagtaaaatatattattctgaataatgaaa

SEQ ID NO: 191399 - DNA, 1119 bp, Homo sapiens
  Payload ID: 17807
  Gene Name: tissue factor pathway inhibitor (lipoprotein-associated coagulation inhibitor)
  Uniprot ID: P10646
  ENST ID: ENST00000409676
  CDS Start-End: 266-1021
agcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaa

SEQ ID NO: 191400 - DNA, 545 bp, Homo sapiens
  Payload ID: 17807
  Gene Name: tissue factor pathway inhibitor (lipoprotein-associated coagulation inhibitor)
  ENST ID: ENST00000437725
  CDS Start-End: 227-545
agttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttactttacgggtggctggcaagatggccgaataggaagagctccagtctacagctcccgcagagatcaacgcagaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagag

SEQ ID NO: 191401 - DNA, 733 bp, Homo sapiens
  Payload ID: 17807
  Gene Name: tissue factor pathway inhibitor (lipoprotein-associated coagulation inhibitor)
  ENST ID: ENST00000453013
  CDS Start-End: 418-733
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaa

SEQ ID NO: 191402 - DNA, 1161 bp, Homo sapiens
  Payload ID: 17807
  Gene Name: tissue factor pathway inhibitor (lipoprotein-associated coagulation inhibitor)
  ENST ID: ENST00000426055
  CDS Start-End: 296-1161
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaa

SEQ ID NO: 191403 - DNA, 554 bp, Homo sapiens
  Payload ID: 17807
  Gene Name: tissue factor pathway inhibitor (lipoprotein-associated coagulation inhibitor)
  ENST ID: ENST00000417013
  CDS Start-End: 327-554
attcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcact

SEQ ID NO: 191404 - DNA, 685 bp, Homo sapiens
  Payload ID: 17807
  Gene Name: tissue factor pathway inhibitor (lipoprotein-associated coagulation inhibitor)
  ENST ID: ENST00000420747
  CDS Start-End: 502-685
ctctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttatgaagtcttgctctgttgcccaggctggagcgcagtggcacaatctcagctcactgaaaccttcgccccctgggctcaagctagccagtcttttagtaaacatttagtcaacaaatctgcaattataacggagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcc

SEQ ID NO: 191405 - DNA, 804 bp, Homo sapiens
  Payload ID: 17807
  Gene Name: tissue factor pathway inhibitor (lipoprotein-associated coagulation inhibitor)
  ENST ID: ENST00000421427
  CDS Start-End: 486-804
aataaacagtcatgtcgctaacacaaagcctgtttggtggtctcttcacatggacgcgcgtgaaatttggtgccgtgactcggatcgggggacctcccttgggagatcaatcccctgtcctcttgttctttgctccgtgagaaagatccacctacgacctcaggtcctcagaccaaccagcccaagaaacatctcaccaatttcaaatccgttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgacaggaaaggccatgtgaggacatagggagaaagcagccaccattggcaagccaagagagagccctcaccaggaacgattggaccagcaccttgatcttggattttctagcctccagaactagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagag

SEQ ID NO: 191406 - DNA, 687 bp, Homo sapiens
  Payload ID: 17807
  Gene Name: tissue factor pathway inhibitor (lipoprotein-associated coagulation inhibitor)
  ENST ID: ENST00000435414
  CDS Start-End: 41-687
attgtaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaa

SEQ ID NO: 191407 - DNA, 2444 bp, Homo sapiens
  Payload ID: 17808
  Gene Name: tissue factor pathway inhibitor 2
  Uniprot ID: P48307
  ENST ID: ENST00000222543
  CDS Start-End: 314-1021
attactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagc

SEQ ID NO: 191408 - DNA, 781 bp, Homo sapiens
  Payload ID: 17808
  Gene Name: tissue factor pathway inhibitor 2
  ENST ID: ENST00000451238
  CDS Start-End: 1-324
gaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaa

SEQ ID NO: 191409 - DNA, 1362 bp, Homo sapiens
  Payload ID: 17809
  Gene Name: tissue specific transplantation antigen P35B
  Uniprot ID: Q13630
  ENST ID: ENST00000425753
  CDS Start-End: 105-1070
tcccggccccgccccccacctggctccgcgggcagccggagcgcacccggccggaagccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 191410 - DNA, 869 bp, Homo sapiens
  Payload ID: 17809
  Gene Name: tissue specific transplantation antigen P35B
  ENST ID: ENST00000529048
  CDS Start-End: 65-869
ggtgaggtggcaccggactcagccgcgccctgggccctggatgctccgtgagagtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaag

SEQ ID NO: 191411 - DNA, 762 bp, Homo sapiens
  Payload ID: 17809
  Gene Name: tissue specific transplantation antigen P35B
  ENST ID: ENST00000524719
  CDS Start-End: 1-195
acagtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcagggtgagccctgaccccacagccctccacttggtggaggcctgccccagcccctccctcatgctcgctaccagggcagaggtgaggtgccccctcagagcctgtactgccctggaggtgggacaccaaagctctgaggggtgacttccctgtccctgggcctcctccccccacttcctcccatgcggccccgaccctccctgtccatggccctcacctgcctgcctctgcagcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 191412 - DNA, 488 bp, Homo sapiens
  Payload ID: 17809
  Gene Name: tissue specific transplantation antigen P35B
  ENST ID: ENST00000526290
  CDS Start-End: 133-488
gttgtttgctgcttgctgcccgagcctgggcgtacccatgggcgcgggtgacagtgcaagtgcttgggacgacaacccgggctcctcatcgcggccggaatccaagaggctgcggcgcgaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccc

SEQ ID NO: 191413 - DNA, 412 bp, Homo sapiens
  Payload ID: 17809
  Gene Name: tissue specific transplantation antigen P35B
  ENST ID: ENST00000527006
  CDS Start-End: 312-412
gtgtttctgggtccttcctgccaggtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtggg

SEQ ID NO: 191414 - DNA, 1324 bp, Homo sapiens
  Payload ID: 17809
  Gene Name: tissue specific transplantation antigen P35B
  Uniprot ID: Q13630
  ENST ID: ENST00000529064
  CDS Start-End: 67-1032
tggacgcaggtgaggtggcaccggactcagccgcgccctgggccctggatgctccgtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 191415 - DNA, 823 bp, Homo sapiens
  Payload ID: 17809
  Gene Name: tissue specific transplantation antigen P35B
  ENST ID: ENST00000530474
  CDS Start-End: 50-397
agccgctgtcggggagccggcggtggggctggacgcaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacgtggctggcctggcctgggtgtgcttggctgtgttcctggaaaaacaaacaccctcccatctcttcctggaagcctgcaccctcatatcagccaggccctggggccaccctcccttttgactgtccctcctgccatagtcccacccagttcctgcacttggcacccaaccctggggtgctggttccctccagagcctcctgacagcctggcttcctacagggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatgg

SEQ ID NO: 191416 - DNA, 871 bp, Homo sapiens
  Payload ID: 17809
  Gene Name: tissue specific transplantation antigen P35B
  ENST ID: ENST00000533817
  CDS Start-End: 276-871
ggccccctcccctaagggctggccctggggccctgccgggggagcccgagcaggtttccggctcccaggatgggatccttgagggtggctgcgccccgaggcctgtcctgccctggaggaatctggctcgccagggctctccaggaccagccagcctcgagtgggcgtgggctgcacacaggcgccgtctcgtgcctgtccctagcatgcgggctttagctgcgaaccgtgttaacgacctgtgccaggagcccccgtcccaaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaa

SEQ ID NO: 191417 - DNA, 1362 bp, Homo sapiens; identical to SEQ ID NO: 191409
  Payload ID: 17809
  Gene Name: tissue specific transplantation antigen P35B
  Uniprot ID: Q13630
  ENST ID: ENST00000612580
  CDS Start-End: 105-1070

SEQ ID NO: 191418 - DNA, 1324 bp, Homo sapiens; identical to SEQ ID NO: 191414
  Payload ID: 17809
  Gene Name: tissue specific transplantation antigen P35B
  Uniprot ID: Q13630
  ENST ID: ENST00000633782
  CDS Start-End: 67-1032

SEQ ID NO: 191419 - DNA, 823 bp, Homo sapiens; identical to SEQ ID NO: 191415
  Payload ID: 17809
  Gene Name: tissue specific transplantation antigen P35B
  ENST ID: ENST00000632250
  CDS Start-End: 50-397

SEQ ID NO: 191420 - DNA, 762 bp, Homo sapiens
  Payload ID: 17809
  Gene Name: tissue specific transplantation antigen P35B
  ENST ID: ENST00000633885
  CDS Start-End: 1-195
acagtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcagggtgagccctgaccccacagccctccacttggtggaggcctgccccagcccctccctcatgctcgctaccagggcagaggtgaggtgccccctcagagcctgtactgccctggaggtgggacaccaaagctctgaggggtgacttccctgtccctgggcctcctccccccacttcctcccatgcggccccaaccctccctgtccatggccctcacctgcctgcctctgcagcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtcccgggcaggcccggcgctttgctccccacaccagccccctgcgcgtgtccactctgatcctgcatcccactccctgggagccaataaagtgcattttcacaggc

SEQ ID NO: 191421 - DNA, 871 bp, Homo sapiens
  Payload ID: 17809
  Gene Name: tissue specific transplantation antigen P35B
  ENST ID: ENST00000632379
  CDS Start-End: 207-871
ggccccctcccctaagggctggccctggggccctgccgggggagccggagcaggtttccggctcccaggatgggatccttgagggtggctgcgccccgaggcctgtcctgccctggaggaatctggctcgccagggctctccaggaccagccagcctcgagtgggcgtgggctgcacacaggcgccgtctcgtgcctgtccctagcatgcgggctttagctgcgaaccgtgttaacgacctgtgccaggagcccccgtcccaaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggcgcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgtcttcgggccccacgacaacttcaacatcgaggatggccacgtgctgcctggcctcatccacaaggtgcacctggccaa

SEQ ID NO: 191422 - DNA, 488 bp, Homo sapiens; identical to SEQ ID NO: 191412
  Payload ID: 17809
  Gene Name: tissue specific transplantation antigen P35B
  ENST ID: ENST00000632368
  CDS Start-End: 133-488

SEQ ID NO: 191423 - DNA, 412 bp, Homo sapiens; identical to SEQ ID NO: 191413
  Payload ID: 17809
  Gene Name: tissue specific transplantation antigen P35B
  ENST ID: ENST00000633095
  CDS Start-End: 312-412

SEQ ID NO: 191424 - DNA, 869 bp, Homo sapiens; identical to SEQ ID NO: 191410
  Payload ID: 17809
  Gene Name: tissue specific transplantation antigen P35B
  ENST ID: ENST00000633165
  CDS Start-End: 65-869

SEQ ID NO: 191425 - DNA, 32767 bp, Homo sapiens
  Payload ID: 17810
  Gene Name: titin
  ENST ID: ENST00000342175
  CDS Start-End: 226-81582
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagtgcaagccctagataggcaaagttctgggaaagatgtaagagagtccaccaagtcccaggcagtggcagattcctctttcacaaaggaggagagcaaaatatctcaaaaggaaattaagtcatttcaaggatcatcatatgaatatgaagtgcaggtttttgaaagtgtatctcaaagttccatccacacagctgcatctgttcaagatacacagttgtgccatactgcatccctttcacaaattgcagaaagcactgagctatctaaggaatgtgctaaagagtccacgggtgaggcgcccaagattttcctgcatcttcaggacgtcactgtaaagtgcggtgacacggctcaattcctctgtgttttaaaagatgattctttcattgatgtaacctggactcacgaaggtgcaaagatagaggaatccgagagactgaaacaatcacaaaatggaaatattcagtttcttaccatatgtaatgttcagctggtagaccaaggactatacagctgcattgtacacaatgactgtggagagaggacaacgtcagcagtactaagtgtagaaggtgctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccaga

SEQ ID NO: 191426 - DNA, 32767 bp, Homo sapiens
  Payload ID: 17810
  Gene Name: titin
  Uniprot ID: Q8WZ42
  ENST ID: ENST00000342992
  CDS Start-End: 224-100495
gcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttccaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaggttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatccggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaatatcttgtagaagaagaagaagagtacattcatgaagaagaggagttcataactgaggaagaagtggtgccagtgataccagtcaaagtgcctgaggtacccaggaaacctgttccagaagagaagaaacctgttcctgttcccaagaagaaggaagctccaccggcaaaagtgcctgaggttcctaagaagccagaggagaaagttcctgtgcttattcctaaaaaggagaagcctccgccagcaaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgccaaagaaacgtgaaccagttccagttcctgtagctctacctcaggaagaggaagttctatttgaagaagaaattgttcctgaagaggaagttctacctgaggaagaggaagttctacctgaggaagaggaagttctacctgaagaagaggaagttctacctgaagaagaggaaattccacctgaggaagaggaagttcctcccgaagaagaatatgtacctgaggaagaagaatttgtacctgaagaagaagtccttccagaagttaaacctaaggtgccagtacctgcaccagtgcctgaaattaagaagaaagtgacagagaagaaagtggtcattcccaagaaagaggaggctccccctgccaaagttcctgaggtgcctaagaaggtggaagaaaaacgaatcattctccctaaagaagaggaagttctaccagttgaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgtcaaagaaaattcctgaggaaaaagtacctgttcctgttcagaaaaaagaggcacccccagccaaagtgcctgaagtaccaaagaaagtcccagaaaagaaagtccttgtgcctaaaaaggaagctgttcccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagtgcctgaagtgctgccaccgaaggaagtggtcccagaaaagaaagtaccggtgcctcctgccaaaaagccagaagctccacctcctaaagtgcctgaggctcccaaagaagttgttcctgaaaagaaagtgccagtgcctcctcctaaaaagcctgaagtgccacccacaaaagtcccagaggtgccaaaggcagctgtcccagaaaagaaggtgcctgaagctattcctcccaaaccggaaagtcctccccctgaagtgccagaggctccgaaagaagttgttcctgaaaagaaagtgccagcggctcctcctaaaaagcctgaagtcacacctgttaaagtgcctgaggctcccaaagaagttgttcctgaaaagaaagtgccagtgcctcctcctaaaaagcctgaagtgccacccacaaaagtcccagaggtgccaaaggtagctgtcccagaaaagaaggtgcctgaagctattcctcccaaaccggaaagtcctccccctgaagtgttcgaggagcctgaggaagttgccctagaagagcctcctgctgaagttgtggaagagccagagccagcggcgcctccacaagtgaccgtaccacctaagaaacctgtcccagaaaagaaagcacctgctgtcgttgccaaaaaacctgaactaccaccagtgaaagtgcccgaggtgcccaaggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatccca

SEQ ID NO: 191427 - DNA, 32767 bp, Homo sapiens
  Payload ID: 17810
  Gene Name: titin
  Uniprot ID: Q8WZ42
  ENST ID: ENST00000359218
  CDS Start-End: 226-81381
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaaggatttagcaaatttgaagaaaatacatcaaactcccaatggcatgtctctttatcagtttcatttaagaaggagccccttggccaaaagcccagcttcatccagcctctgtcaagcctcagggtgcacaacggggagacagtcagatttcatgcgagggtttctggcattcccaagccagaaatccaatggtttcataaccagcagctaattctaccaacaaaagatgtagttttccattttgaggagtccacaggcatggctttaatgcttatagttgatgcttactcagagcatgctgggcagtactcttgcaaagcagccaatagtgctggggaagccacttgtgcagctacactcacagtgactccaaaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattc

SEQ ID NO: 191428 - DNA, 18218 bp, Homo sapiens
  Payload ID: 17810
  Gene Name: titin
  Uniprot ID: Q8WZ42
  ENST ID: ENST00000360870
  CDS Start-End: 224-17038
gcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagaattattctctgagggggaatctgaacattcagaaagggatacacgtgacgccttttcagattctgaagacatagaccacaaatccatggctgctaaaagatatgcaagtagaatatcatctacaagctcctggcctgaatattttaagccttcttttacccagaaacttacatttaaatatgttttagagggtgaaccggttgtttttacatgtagattaattgcctgtccaactccagaaatgacttggtttcataacaatcggcccatcccaacaggtcttcgtcggattataaaagctgagagtgatttacaccatcactcttccagcttagagattaaaagggtccaagacagagattctggaagttataggttactagcaattaatagtgaagggtctgcagaatcaactgcatcattgcttgttatccaaaaagggcaagatgagaaatatttagaatttctgaaaagagcagaacggacacatgaaaatgtggaggctttagttgaaaggggagaagataggataaaggttgacctgaggtttactggctctccctttaacaaaaaacaagatgtggaacaaaagggaatgatgagaactatacattttaagacaatgagttctgccaagaaaacagattacatgtatgatgaagaatatttagaaagtaaatctgacataagaggttggcttaatgtaggtgaaagtttcctggacaaggagaccaaagtgaagttgcaacgtttaagggaggctagaaaaacattaatggagaaaaagaaattatctcttttagatacgtcttctgaaataagctcaagaactttgagaagtgaagctagtgataaagatattctgttctctagagaggacatgaaaatcagatctatgtctgatctagctgaaagttataaggtagatcattcagctgagagtattgtgcaaaatccacatgccctttctaatcaaatggatcaaaatatagaatctgaggaacttcccacaagctttcaaactattgttgatgaagaaattttccagactgaaataagaatgagccaagaagcactggtaaaggaaagtctaccaaaagaccatttatatggtgaaattctagtaaatgaaaatacccaagcaagaggacagctggaagaaattatggccaatactacaattggagagtcatccacatatatcactaatgtatgtgagaaggaggaagtatatgagactcctgaaaatgtgtctcaagctattacaccacatgccagcgaatcttttggtacacttgtaaatgttgaagaaagtgaagaaatagctagtgaaagaataaaaaaggatgatttgagagaattacaactctctgcttctacacgaattgatgaattcaaaaccgaacagaaggaagaaaacatgagattttttgaaaattcttttcgaaaacgcccacaacgttgcccaccttcatttcttcaagaaattgaatctcaagaagtttatgaaggtgacagttgtaattttgtgtgtcattttcaaggatatcctcaacctatagtgacgtggtataacaatgacatgccaatcccacgtaatcaaaactttatcattcattcgttggaaaactattcaatattaactctttcatctgttcatcatcagaatgaaggttctattacttgtgtgctatttaaccaatatggaacagtaaaaacaaccagtatgcttaaagtgaaagcaaaacaaaaacatgatgtcaaagcacataaagtcccagtgttccatgactacttggatgaggaagaagagttagcattggtgtttgaccaagcaaaaggcgcccatccatctatgagtcaagagggccaaacaaatcttcatttgttaaaaactaacccaccagttcctccctctggagacacagaattgctttcctttcctgtagaaattcaggtaacagcagctactcctatcccagaacaggataaagagtctaaagaagtgtttcaaactgaggagctggaacctaaagcaatgcctcaagatcaagttactcaatcaccaaaacacagatttgtatttttgtctgatattactaatgaaccaccaaaaatgttacaagaaatgccaaagcatgccaggtgtagagaaggggattccatcattcttgaatgtttaatatctggtgagccccagccagttgtaacatggtttcaaaatggagtccttttaaagcagaaccagaagtttcagtttgaagaagttaattgtagccaccaattatatattaaggatgttaattctcaagattctggaaaatataaatgtgttgctgaaaacaattcaggggcagttgaaagtgtttcagatctaacagtggagcctgtcacttatagagaaaatagtcaattcgaaaatattggtgaaatttatggaaaatattccagagatcagcaactgcaagaccagggagaatctgtaagggcacatttttatgattatccagctggtccctttactccctggacaaatgtaaaagaatattcagtaagggactattttcaaagccttgagactattgagcaaatagaccagaaagagcaggtgcgttgcataccttctagagaaaaaattcccagatttgtgcatggtgcttcaagaaccataaaaatcagcaagcccatcagggctgaattcatacaatgtcaggctgaagggaaagagagacatgtaagtgaaaaatcaaagctgcaccaagcagagggtactgtttatccatttgttgatgatttcagtgatgtcactattaagaaagaaataagaaataattttggaaaacttggtagatcagaaaaggaaaatgtacaagaatgtgcccaaagtgactatttaccaaatattcactctgagagaatttctgacagttacaatacaaaagattcatctgccattgtatatgaagaatcccttggtgaagagatacactacccggggaaaaaggtgaagcatagaattatcgaatttgaaaaattacatgtagaaaaaggagttctagaaaaaagacctaccagaacatcaattgttaatcctcctcaaaagaagattgatgacaaagccttttcattaaagcaaagagaatcaagatcaagcaatctaaatgcaaatatgtatcaggcagagaaaatgtctccaaatactgaatcagattcatctaacattgcaataaatttaaagctgctttcctctcaaactcataaagaatttgacgcacaagaaagggaacaacaggaaaaaataagtcttatagataaacctgcaatttctaaaagagctgaacatgaatcacctattacatttgacttaaagcagtttcacactcaaataaaacacacagatgtgaaattccaagaattagatagtggtcaaccagaagaagcttattttaaaatccaacatcctgctgacactgagaacattgtatttgatctaaaacaaatgtattctcatataggagatccagctctggagttccaagggcaagaaactagggaacagcaggaaatacattataaagaaaaaattcctagccctgaaacgttacaacctgacacacacaatatctctaaaagtgtgcaaaataatgtatttgccagtcaagaaatttcttccagtcaagagctttcaaatagaactatggtggagaaaagtagtattgatgaaaattccatttctttagaaaaagaagtccgacatgtacaggaacaaaacttagacattttaaaaactgatctttctcttaaatccttttctgaagaaatctatagtgaatcatgtgccctacttccaacctcatctgcagatatagaagaaactgatctttctgagaaaagttgtcctctagaaaatggaggcagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttctcaaaatattcctaaattagatgaggcacataccactgaggcagcagaatctgagacctccctaacacaatatttacttgctgctggaaagcgtgaggttcctgaaactaaagacaccagagaccaggcaaagcttgtccagagtgaatcaatcacttcaatggaggtggaagaagtaactttcaacactgtgtatgaatactacaaccagaaacaggaatcactaggtcgtccactttctcctgagtctgacatttccattggtgtgggaagtacaaccagtgaagaaatatctgagttagatcagttttataccccaccatcatctgttgaatattttgaatctccaaagtcccctgacttatattttaatccttcagatataactaaacaatcctcaatacattcaggaggtgagacagttgaaagatattccacacctttaggggaagttgctgaaagatattcaacaccttccgaaggtgaggtaggagaaagatactccacacccccaggggagacactagagagatactccacacctccaggagagactctagagagatactccacacccccaggagagactctagagagatattccacacccccaggagagactctggagagatactccacacccccaggagagactctagagcgatattccacacccccaggggaggcactagagagatattctattcctactggaggaccaaaccccactggtacttttaaaacatatccatcaaaaatagaaagggaagacggtacaccaaatgagcatttctacacacctacagaagagaggggttcagcttatgaaatatggcgttccgattcatttggtacacccaatgaagccattgagccaaaagacaatgaaatgcctccatcttttattgaacctctgaccaaaaggaaggtatatgaaaacacaacactaggcttcattgttgaagttgaaggtcttccagttcctggtgtgaaatggtatcgaaataaatctttactagagccagatgaaagaatcaaaatggaaagagtgggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgaatttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaattggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacctaattgtttgtacttctatttaccctcatgcctcctccacaaagtgtttcagtggaatggactctcttttagcagataaaccatatatgcaaaagtacaatgtaaaagtggagaccatatcagatgaccacgcagacaaattggtaagggcaaatctctctgctcccattctaagttatttttggaattttaacccctttgcatccaaactcatgtttatttactttgacttagaataggcaaaacaaacaacaaaaaccagcttctcccaattggcaactaactctataatctgtttgacatttcaatcttaatatattaacttcatctcttttaaaaatgttttcgttattaatattcctcttcataagtgctttaattctcactggcttcaagggaccaattgtgctctttgtgggcagggttcacctagacatttgcaaaataagcaaatagatctttccacttttggagataccttatttttctccatttttgagatgacatcaagtgtaaaatgcagcaataatttagtattggcctggggaaaaaagggaaactatcatattgtgtttacatatagattttaaaactgtattctgatttcagaatctttaaaatttaaaaaaaggtgggatatttttagaattgagacaatatggtaatttgtatttcagattatatataaataacaagataacaagctttcctatcagtttcactgaatttcatctttaaaacgaatatagcttaataagcattcaatttttattgtgatgtttatgtttctaaagtaactctttaattttgtcttttaaaattaaaataacagtaaattaacatactccttaatatcttacctatatactaatgtggacccaagtcttctcatataagactcgacaaatataaaaaa

SEQ ID NO: 191429 - DNA, 766 bp, Homo sapiens
  Payload ID: 17810
  Gene Name: titin
  ENST ID: ENST00000426232
  CDS Start-End: 1-766
ggaggttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaa

SEQ ID NO: 191430 - DNA, 635 bp, Homo sapiens
  Payload ID: 17810
  Gene Name: titin
  ENST ID: ENST00000412264
  CDS Start-End: 490-635
gttccagttctgctgagacacaacttcccctgggaagcctcctgacccatcaagtccagagtagatggtcctgccatgtgcactgtcagcacctgcactgcccagccacgcccctgaatatacacaaaggaatcgcagatcaagagagaaaaaatagaaggaaattgtaattacaggattgctgagctgggctttctccaataataacatgatcaaaataaaataaaagaagtccttttggcctctgacatcacatcctggagtggatgatttaccagttggtcatctgctgtgctgcaggaatgaatgtagctactgtggtatgaagcaaaattctaacgttcctagaaagtgttagacctgtcaacctccaggaaggatgagatctgcttccacactgcacagtgtccagaagatcaggaccatgtgtcacttggttcaaagatgacttctaagtggtacctggagatactgaaagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttc

SEQ ID NO: 191431 - DNA, 723 bp, Homo sapiens
  Payload ID: 17810
  Gene Name: titin
  ENST ID: ENST00000425332
  CDS Start-End: 1-723
ccagaggcatttttccagaggtggagccacctgaggctattcctgaaattccagaacatcctccaactgaagagtttgaagtcttcaaggaagtcattccagagggagaaactcctattgttaaaagaagaaaaacaccatcaccaacagcaccagaagctatgaaagaagttgtccctgaaatgaaaatatttgaggatgtacctgaagagccagaaactccacgtatgaaaacgcccgaagctcctcaagaaattattcctgccaagacagttccttccaaaaaaagagaacccccatcagttaaagtgcctgaagctctccaagaaattgtccctgaaaagaaaacgcttgtggttcctctcagaaagcctgaagtccttcctgatgaagtgccggaggctctcagagaagttgtcccggaaaagaaagtgcatcctccccaaagggctgaagttgtacctgtcaaagtgcacgaagctcccaaagagattatccctgaaaagaaagtgtcggtggtgcctcctaaaaagcctgaagtcccacctgttaaagtgccagaagcttccaaagaggttatccgcgaagagaaagtgcccttggctcctcctaaagagcctgaagtcccacctgttaaagtaccagagcctcccaaagaagtagttcctgaaaagaaagcgccagtggctcctcctaaagagcctgaagtcccacctgttaaag

SEQ ID NO: 191432 - DNA, 519 bp, Homo sapiens
  Payload ID: 17810
  Gene Name: titin
  ENST ID: ENST00000448510
  CDS Start-End: 1-519
ccccagctaaagggagaactgtccttgaagaaaaagtatcagttgccttccgccaagaagtagtagtaaaagaaagactagaattagaagtagtagaagcagaagtggaagaaattccggaagaagaagagttccatgaagttgaagaatattttgaagaaggcgagtttcatgaagtagaagaattcatcaaattagaacaacatagagttgaagaagaacacagagttgaaaaagttcatagggtaatagaagtttttgaggctgaagaagtggaagtatttgaaaaaccaaaagctccacctaaagggcctgagatatctgagaaaatcatccctccaaaaaaaccgcccactaaagttgttcctcgaaaagagccaccagctaaagtaccggaggtgcctaagaaaattgtggtagaagaaaaagtacgtgttcctgaagagcccagagttccaccaactaaagcacccgaagtacccaagaaaattgtcccagaagaaaaagttcgtgaagctg

SEQ ID NO: 191433 - DNA, 2887 bp, Homo sapiens
  Payload ID: 17810
  Gene Name: titin
  ENST ID: ENST00000414766
  CDS Start-End: 1-2887
tacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagttcctgaagtgcccaagaaacctgtgccagaggagaaagtaccagtaccagttcctaaaaaggtggaagctccacctgccaaagtgccagaggtacccaagaagcctgtgcctgagaagaaggtgccagttcctgctcctaagaaagtggaggctccacctgcaaaagtgccagaggtgcccaagaagctcatcccagaagaaaagaaaccaacacctgttccgaaaaaagtggaagcaccaccacccaaagtgactgaggagcctgaagaagagcctatttcagaagaagaaatcccagaagaaccacctagcatagaggaagttgaagaggtggcaccacctagagtgcctgaagtgattaagaaagcagtacctgaagcacctactcctgttcctaaaaaagtggaggcaccaccagctaaagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcaggtgtacccaaaaagactccttcaccaatagaagccgaaaggagaaagt

SEQ ID NO: 191434 - DNA, 641 bp, Homo sapiens
  Payload ID: 17810
  Gene Name: titin
  ENST ID: ENST00000436599
  CDS Start-End: 1-641
gcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtaga

SEQ ID NO: 191435 - DNA, 1118 bp, Homo sapiens
  Payload ID: 17810
  Gene Name: titin
  ENST ID: ENST00000446966
  CDS Start-End: 1-1118
gttgttcctgaaaagaaggtgcctctggtggttcccaaaaagccagaagccccacctgctaaagtgcctgaagttccaaaagaagttgttccagaaaagaaagtagctgttcccaaaaagccagaagtcccaccagcaaaagtgccagaagtgccaaagaaacctgtcttggaagagaaaccagctgttcctgttccagaaagagcggagtctcctcccccagaagtatatgaagaacctgaggaaattgctcctgaagaggaaattgctcctgaagaggaaaagccagttcctgttgcagaagaggaggaaccagaggttccacctccagcagtgcctgaagagcccaagaagatcatcccagagaagaaagttcctgtcatcaaaaaaccagaagcaccgcctcctaaagaacctgagatgccaaagaaagttgttccagtgaagaaggtcccaactgttaagaagccagaaacaccagcagctaaagtgcctgaggtgcccaagaaacttgttccagtaaagaaagaacctgtgcctgttaccaaaaaaccagaagttcttccagaaaaagtgcccaaagtgcctgagaaaatcatcccagaaaaggaagtgtctgtgcctatccctgcagagccagaagttccacctgctgaagttgaagagactcctgaggaaataatatatgaagaaaaagcatctataaccattggtagaaaagagactccccctgttgaagaacgtgaaattgaaaagtatattaaacctgaagagcccgaacctgaaccacagcctgaagaaataccagtaaaagaacctgaacctgaaaaggttattgagaagccaaaactcaaaccaagacccccacctcctccacctgctccacctaaggaagatgtgaaggagaaaatattccaacttaaagctattccaaagaagaaagttcctgaaaaacctcaggttccagaaaaagtggagcttacacctctgaaagtaccagaaccaccacctccaaaacctgttgaagaggttgaagtacctactgttacaaaaagggaaaggaagattcctgaaccaacaaaagtgcctgaaatcaagccagcaatacctctccctgc

SEQ ID NO: 191436 - DNA, 32767 bp, Homo sapiens
  Payload ID: 17810
  Gene Name: titin
  Uniprot ID: Q8WZ42
  ENST ID: ENST00000460472
  CDS Start-End: 226-81006
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaataaaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaaggcagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaaggccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgttggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaatgaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaaggacaaagtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagagggtggggaatatgaattccgagtcaaagctgtcaatgctgcaggagtcagcaagccttcagccactgttggccctgtgactgtcaaagaccagacatgcccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagcttgttgtgacaggattaaaggaaggagcattctacaaatttagagttagagcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccgtcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactggatgatggtggttctgttattaccaattatg

SEQ ID NO: 191437 - DNA, 32767 bp, Homo sapiens
  Payload ID: 17810
  Gene Name: titin
  Uniprot ID: Q8WZ42
  ENST ID: ENST00000591111
  CDS Start-End: 226-103278
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttccaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaggttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatccggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgcccccacctaaagtgccagaagagccaaagaaaccagttccagaaaaaaaggttcctccaaaagtcattaagatggaagaacctctcccagccaaagtgactgagaggcacatgcaaattacccaggaagaaaaagttcttgttgctgtaactaaaaaagaggcgcctccaaaagcaagagtgccagaggaaccgaagagagctgtcccagaagaaaaagttctgaaactcaaacctaaaagagaggaggaaccaccagctaaagtgactgaattcagaaaaagagtggttaaagaagaaaaagtatcaattgaagctccaaaaagagaacctcaacccatcaaagaagtaactataatggaagagaaagaaagggcttataccctagaagaagaagctgtttcagtacaacgggaagaagaatatgaggaatatgaagaatatgattataaagaatttgaggagtatgaaccaacagaagaatatgaccaatatgaagaatacgaggagcgggagtatgaacgatatgaagagcatgaagaatacatcacagaaccagagaagcctatccctgtaaagcctgtcccagaagaaccagttcccacaaaaccaaaggccccaccggctaaagtgctgaagaaagctgtccctgaagaaaaagtaccagtgcccattcctaagaaactcaaacctccaccacccaaagtgcctgaagaaccaaagaaagtttttgaggaaaaaatacgtatttcaattaccaaacgtgaaaaagagcaggtgactgaacccgctgctaaagtgcccatgaagcccaagagggttgtcgcagaagaaaaagtacctgtccctagaaaagaagtagcaccacctgttagagtgccagaagtgcctaaagaacttgaaccagaagaggttgcctttgaagaggaagttgtaacccatgtagaagaat

SEQ ID NO: 191438 - DNA, 32767 bp, Homo sapiens
  Payload ID: 17810
  Gene Name: titin
  ENST ID: ENST00000589042
  CDS Start-End: 226-108201
gagcagtcgtgcattcccagcctcgcctcgggtgtagggattgcatagaaaagcaaaactacacagtcttgactgtgtagttttgtttttaggattagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctaaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgattcaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaagggcaaactgccagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattggtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttacaagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaaggatttagcaaatttgaagaaaatacatcaaactcccaatggcatgtctctttatcagtttcatttaagaaggagccccttggccaaaagcccagcttcatccagcctctgtcaagcctcagggtgcacaacggggagacagtcagatttcatgcgagggtttctggcattcccaagccagaaatccaatggtttcataaccagcagctaattctaccaacaaaagatgtagttttccattttgaggagtccacaggcatggctttaatgcttatagttgatgcttactcagagcatgctgggcagtactcttgcaaagcagccaatagtgctggggaagccacttgtgcagctacactcacagtgactccaaaagtgcaagccctagataggcaaagttctgggaaagatgtaagagagtccaccaagtcccaggcagtggcagattcctctttcacaaaggaggagagcaaaatatctcaaaaggaaattaagtcatttcaaggatcatcatatgaatatgaagtgcaggtttttgaaagtgtatctcaaagttccatccacacagctgcatctgttcaagatacacagttgtgccatactgcatccctttcacaaattgcagaaagcactgagctatctaaggaatgtgctaaagagtccacgggtgaggcgcccaagattttcctgcatcttcaggacgtcactgtaaagtgcggtgacacggctcaattcctctgtgttttaaaagatgattctttcattgatgtaacctggactcacgaaggtgcaaagatagaggaatccgagagactgaaacaatcacaaaatggaaatattcagtttcttaccatatgtaatgttcagctggtagaccaaggactatacagctgcattgtacacaatgactgtggagagaggacaacgtcagcagtactaagtgtagaaggtgctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcagagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcaccaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagaggcatatccaccaacctttctctccagacctaagtcccttacaacttttgtgggtaaggcagccaagttcatctgcacagtgacagggactcctgtgatagaaaccatttggcagaaagatggtgctgcactctcaccttcacctaactggaggatttccgacgcagaaaacaaacacattttagaactctcaaaccttaccattcaagatagaggagtttattcttgtaaggcttccaacaagtttggagcagacatctgccaagcagagttgatcatcattgataagccacatttcattaaagaattagagcctgtgcagtccgctatcaataagaaggtccaccttgagtgccaagtagatgaagacagaaaagtcacagttacgtggagcaaagatgggcaaaaactccccccagggaaagattataagatctgttttgaagataaaatagcaacacttgagattcctttggccaaactgaaagattcaggaacctatgtctgtacagcttcaaatgaggctggaagcagctcctgctcagccacagtcactgtcagagagccaccatccttcgtgaagaaggtggatccctcttatttaatgctcccaggtgaatcagcacgcctccattgcaagctgaaaggctcacctgtgatccaggttacttggtttaaaaataacaaagaactcagtgaaagtaacacagtccgaatgtattttgtcaattctgaggctatacttgatattacggatgtaaaagttgaagacagtgggagttactcatgtgaagcagtgaatgacgtcggcagtgatagctgcagtactgaaatagttatcaaagaacctccttctttcatcaaaactcttgagcctgcagacatagtgagaggaacaaatgctctacttcagtgtgaagtctcaggcactggaccatttgaaattagctggttcaaagacaagaaacaaattcgaagtagtaaaaaatacagattgttttctcagaagtctcttgtgtgtctggagatcttttcgtttaatagtgcagatgttggtgaatatgaatgtgttgttgctaatgaagtcggcaagtgtggctgcatggcaacccacttactcaaagaacctccaacctttgtaaagaaagtagatgatttgattgcactaggaggacaaaccgttaccctgcaagctgctgtgagagggtcagagcccatttctgtcacatggatgaaaggtcaagaggtcatcagagaagacggaaaaatcaaaatgagcttttccaatggtgttgcagtcttgataatccctgatgttcagattagttttggaggcaaatacacgtgcctggctgaaaatgaagctggaagccaaacatctgttggggaattaatagttaaagaacctgccaaaatcattgagcgagcagaactgatccaggtgacagcaggagatcccgccacactggagtacacagtggcaggcacgccagaactgaagcccaaatggtacaaagatgggagacccttggtcgccagtaaaaaataccgaataagttttaaaaacaatgttgcccagctcaaattttattcagctgagctgcacgacagtggccaatacacatttgagatttccaatgaagtgggcagcagctcctgtgagactacattcactgtattagatcgagacattgctccattttttaccaaacccttgcgcaacgtggatagtgttgttaatggtacctgcagactggactgcaaaattgcaggctccctccccatgagggtgtcctggtttaaggatggcaaagaaatagctgcttctgacagatacaggatagcatttgtggaaggcacagcctctttggagatcatcagagtagacatgaatgatgcagggaatttcacttgtcgagccacaaattccgtgggaagcaaagacagcagtggagccctgattgtgcaagaaccacccagttttgtaactaaacccggctcaaaggatgttctgcctggctcagcagtctgcctgaagagcactttccaaggatctactcctctcacaatcagatggtttaagggcaacaaagagctggtttctggtggaagctgctatattaccaaagaagctttagagagttccctggaactctatttagtaaaaacctctgattcgggcacgtacacatgtaaagtcagcaatgtcgctggaggggtggaatgcagtgcaaacttgtttgtaaaagaacctgccacatttgttgaaaagttagagccatcacagctgttaaagaagggagatgccacccagctagcctgcaaagtaactggtacccctccaattaaaataacatggtttgcaaatgatagagaaattaaggagagcagcaaacacagaatgtcttttgtggagtctactgcagttctaagactgacagatgttggcatcgaagacagtggtgaatatatgtgtgaggcccaaaatgaggctggcagtgaccactgcagtagcattgtaatagtcaaagagtcaccttattttaccaaggaatttaagccaattgaagtcttaaaggagtacgatgtcatgttgctggctgaggtggcaggcactcctccctttgagatcacttggttcaaagataacacaatcctgcgaagtggtagaaagtataagactttcattcaggatcatctggttagcctgcagatcctcaagtttgtagctgcagatgctggcgaataccagtgtcgggtgaccaatgaggtgggcagcagcatctgcagtgccagggtgactttaagagaacccccatccttcataaagaagatcgagagtaccagctccctccggggaggcacagctgccttccaggccactctgaagggctccttgccaattacggtgacttggctaaaagacagcgatgaaatcactgaagacgataatataagaatgacctttgagaacaatgtggccagtttgtacctcagtggcattgaagtcaagcatgatgggaaatatgtctgtcaggccaaaaatgatgcaggaatacaaagatgttctgcattactctcagtaaaagaacctgcaacaatcaccgaggaagctgtgtctatagatgtcacccaaggagacccagccactttgcaggttaaattttcagggactaaggagattacagccaaatggtttaaagatggccaagaactgaccctgggctcaaaatataaaatcagtgtcactgatacagtctcaatactgaagattatttctacagaaaagaaagatagtggagaatatactttcgaggtccaaaatgatgttgggaggagcagctgcaaggctagaattaatgtattagatcttatcatacctccttcattcaccaaaaagctgaagaaaatggacagcattaaaggttctttcattgatttagaatgtatagtggctgggtcacatcccataagcatccagtggttcaaagatgaccaagaaatatcagctagtgaaaagtacaaattctcttttcatgacaatactgccttcttggaaatcagccagctggaaggtacagacagtgggacatacacttgttctgccacaaataaggcagggcacaaccaatgcagtgggcatctgacagtcaaagaacccccttactttgtggaaaagccacagtcacaagatgtcaatcccaacacaagggtacagttaaaggctcttgtgggtggcactgcacccatgacaataaagtggtttaaagataacaaagagttacactcaggagcagcccgctcagtttggaaggatgacacctctaccagtctagagctctttgcagccaaagctaccgattctggaacctacatttgccaactaagcaatgatgttggcacagcaaccagcaaagccactctctttgtaaaagaacctcctcaattcattaagaagcccagtccagtcttagtgctgaggaatggacagtcaacaacatttgaatgccaaataacaggcactcctaaaatccgagtgtcttggtatctagacgggaatgaaataacagccattcagaaacatggcatttccttcattgatggtttagccactttccagatttctggtgccagggtagaaaatagtgggacttatgtgtgtgaagctcgaaatgacgcaggcacggcgagctgcagcattgaactcaaagtgaaagaaccccccacctttatcagagagctgaagcctgtggaggtagtaaaatatagtgacgtggagctggagtgtgaagttacgggaacacctccgtttgaagtcacttggctgaagaataacagggaaattcgaagcagcaaaaaatacacattgaccgacagagtgtctgtgtttaacctccatataaccaagtgtgacccttcagacactggggaataccagtgcattgtatccaatgaaggcggcagctgctcatgcagtactagagttgccctgaaagaaccaccatcattcattaagaagatagaaaataccactactgttttgaaaagttctgccacctttcagagtaccgtggcaggttctcctcctatttctataacctggctaaaggatgatcagattcttgatgaagatgataatgtctatatttcatttgtggacagtgtggccacacttcaaatcagaagtgtggataatggacacagtgggagatatacctgtcaagccaagaatgagtcaggagttgagaggtgttatgctttccttttagtacaagaaccagctcaaatcgtagagaaagctaaatcagttgatgttacggagaaagatcccatgaccttggaatgtgttgtggctggaacaccagaactcaaagtgaaatggcttaaagacgggaaacaaatagttcccagtagatacttttcaatgagttttgaaaataacgtggccagttttagaattcagtcagtaatgaagcaggacagcggtcagtacactttcaaggtggaaaatgacttcggaagcagtagctgtgatgcctacttaagagtgctagatcaaaatattcctccatcattcaccaaaaaattaaccaaaatggataaagttctgggctcttctattcatatggagtgcaaggtgtctggttcacttcccattagtgctcagtggtttaaggatggaaaagaaatatctacaagtgcaaaatacagacttgtgtgccatgagagatctgtgtctctggaagttaataatctggaattagaagatactgcaaattacacatgcaaagtgtcaaatgtagcaggagatgatgcatgcagtggcatcttaactgtgaaagaaccaccaagcttcctagtgaaacctgggcgacagcaagccatacctgattctacagtggaatttaaggcaatactaaaaggaacaccaccatttaaaataaaatggtttaaggatgatgtggaacttgtctcaggtcctaaatgtttcattggcttggaagggtcgactagcttcttaaatctctactcagtggatgcttctaagactggacagtatacttgccatgttaccaatgatgttggtagcgactcttgtactacgatgttgcttgtgacagaaccaccaaagtttgtaaagaaattagaagcctccaaaattgtgaaagcaggtgactcttcacgacttgaatgcaagatagctggatccccagaaatcagagttgtgtggttccgaaatgaacatgaacttccagccagtgataagtacagaatgactttcattgactcagtggccgtcatacagatgaacaatctcagtactgaggacagtggagatttcatttgtgaggctcagaatcccgctggcagcacaagctgcagtaccaaggttatagtaaaagagccacctgtttttagcagcttccctcctatagtagaaacccttaaaaatgctgaagtcagtcttgaatgtgaactttcgggaacaccaccgtttgaggtggtatggtacaaagacaagcggcaactcagaagcagcaagaaatacaagattgcatccaaaaacttccacacaagtattcacattctcaatgtggacacttcagacatcggtgaataccactgcaaagcacagaatgaagtgggaagtgatacttgtgtttgtactgtaaaattgaaagaaccaccaagatttgtctccaaactgaacagcctcactgttgtagccggagagcctgctgaattacaagcatccatagaaggcgcccagcctatttttgtccagtggcttaaagagaaggaagaagtgattagagaaagtgaaaacatcaggattacatttgtggaaaatgttgcaactctacagtttgcaaaagcagagccagctaatgctggaaagtatatctgccaaatcaagaatgatggtggaatgagggagaacatggccacactgatggtcttagagcccgcagtcattgttgagaaggcaggaccgatgacggtgactgtaggagaaacgtgcactctggagtgtaaggtggctggcactccggaactctctgttgaatggtacaaggatggaaagctgttgaccagcagccaaaaacacaaatttagcttctacaacaaaatctcttccttaaggattctctcagttgaaaggcaagatgcaggcacatacactttccaggttcaaaataatgttgggaaaagcagctgcacagctgtggttgatgtttcagaccgagcagttcctccctctttcacacgaagactgaaaaatactggtggggtgttaggtgcttcttgcatcttggaatgcaaagtagctggatcatcacctatttcagttgcctggtttcatgagaaaaccaagattgtcagtggagcaaagtaccaaaccacattttcagataatgtctgcacattgcagttgaattctctggattcctcagatatgggcaattacacatgcgtggctgctaatgtcgctgggtctgatgaatgtcgtgcagtgctaactgtacaagaaccaccctcttttgtgaaagaacctgaacctttggaagtactaccaggcaaaaatgtaaccttcacaagcgttattagaggaacccctccattcaaagtcaactggttcagaggtgccagagaactagtgaaaggagaccggtgcaacatctattttgaagacactgtggcagaactggaattatttaatattgacatatctcagagtggggaatacacctgtgtggtttctaacaacgctggccaagcatcttgcactacccgtctctttgtgaaagaaccagctgcatttttgaagagattaagtgatcattctgtagaaccagggaagtccataattctggagagcacctacactggaacacttccaatttctgtcacttggaaaaaggatggttttaacataactacctctgaaaaatgtaacatagtcacaacagagaaaacttgtatcctggaaattctgaatagcacaaaaagagatgcagggcagtattcctgcgagattgaaaatgaggcaggaagggatgtttgtggagctctggtatctacattagaaccgccttattttgttacggaactggaacctctggaggcagcagttggagattcggtttctttacaatgccaagttgctgggacaccagaaattacagtgtcttggtacaaaggagataccaaattacggccaactcctgaatacaggacctactttacaaacaatgtggccacacttgtttttaataaagtgaacatcaatgacagtggagagtacacatgcaaagcagaaaatagtataggaactgcttcttctaagactgtgttcagaattcaagagcgccaactcccaccttcttttgcaagacaattaaaggacattgaacaaactgtggggttacctgttacactcacttgtcgattaaatggctctgcacccatccaagtgtgctggtatagagatggagtacttttaagagacgatgaaaatctacagacttcatttgtagataatgtggcaactttaaaaattttgcaaactgacttgagtcactctggccagtactcttgctcagcttccaacccacttggaacagcatcttctagtgctagactcacagcaagagaacccaagaaatctcccttctttgacatcaagcctgtatctatagatgttattgctggagaaagtgctgattttgagtgtcatgttactggtgctcaaccgatgcgaatcacttggtcaaaagataacaaggagatccgtcctggaggaaactatacaatcacatgtgtgggaaacactcctcatttgagaattcttaaagtaggcaaaggagactctggtcaatatacttgccaagcaaccaatgatgttggcaaagacatgtgctcagctcagctcagtgtaaaagaacctccaaagtttgttaagaaattagaagcttcaaaagttgcaaagcagggagaatccattcaactggaatgtaaaataagtggctccccagaaatcaaagtttcatggttccgaaatgacagcgaacttcatgaaagttggaaatacaacatgtcattcattaattctgtggcattgcttacgatcaatgaagctagtgctgaagacagcggggactacatttgtgaggctcataatggtgttggtgacgccagctgcagcacagcgttgacagtgaaagcacctcctgttttcacccagaagccttctccagtaggagctcttaaaggttctgatgtgattctccaatgtgaaatttcgggaactcccccatttgaagtagtatgggttaaagatcgaaagcaggttagaaacagcaagaaatttaaaatcacttcaaaacattttgatacaagtcttcatatccttaatcttgaagcctccgatgtcggggaatatcactgcaaagctactaatgaggtgggaagtgacacgtgttcttgctctgtcaagttcaaagaacctccacgattcgtgaaaaagctaagtgacacctcaacccttattggggatgctgttgagttacgggccatagtggagggcttccagccaatttctgttgtctggctgaaagatagaggtgaagtcatcagagagagtgaaaataccaggatttcattcattgataacattgcaaccctccagctggggagtccagaagcatctaattctggaaaatatatatgccaaatcaaaaacgatgctggaatgagagaatgctctgcagtcttgactgtactagaaccagcaagaatcatagagaagcccgaacccatgactgtcactactggaaatccttttgcattagagtgtgtagtgactggaacaccagaactctcagccaagtggttcaaagatggaagagaattgtctgcagacagcaaacatcacattacattcatcaataaagtggcttcccttaaaatcccctgtgccgaaatgagtgacaaaggattatatagctttgaagtgaaaaacagtgttggcaaaagtaactgcactgtatccgtccatgtttctgatcggattgtgcctccttccttcatccgcaagctgaaagacgtgaatgccatcctgggggcctcagttgttttggagtgccgagtctctggctcagccccgatttcagttggctggtttcaggatggaaatgagattgttagtgggcccaaatgtcagtccagcttttcggaaaacgtctgtactttgaatctgagcttgttggagccctccgacacaggcatatacacgtgtgtggctgccaatgtagctggttccgatgagtgctcagcagtcctgactgtgcaagaaccaccatcttttgaacaaacccctgattctgtggaagttttgcctggaatgagcctcacattcaccagtgtcatcagaggcacccctcctttcaaggtcaagtggtttaaaggcagcagggaactggtgcctggggagtcatgcaacatctctctggaagattttgtcacagaactggagttgtttgaggtgcagccattagaaagtggagactattcttgcctcgttacaaatgatgctggcagtgcttcctgtaccacacatctttttgtgaaagaaccagccacctttgtgaaaagattggctgatttcagtgttgagacaggaagccccatagttctcgaggccacatacactggcacacctccaatctcagtgagctggataaaggacgagtatcttatttcacaatctgagagatgcagtattactatgacagaaaaatctaccatactggaaattcttgagagcacaatagaggattatgcacagtacagctgcctgatagaaaatgaggctggtcaagatatctgtgaagctctggtgtctgtcttagaaccaccgtactttattgaacctctggaacatgtggaagcagtcattggagaacctgcaactttacagtgtaaagtggatggaactccagaaattagaatttcttggtataaagaacacacaaagctacgatcagctcctgcatataaaatgcaattcaaaaataacgttgcttccttagtaatcaacaaagtggatcacagtgatgtgggagagtattcatgcaaggcagacaacagtgtgggggcagtcgcttcttcagctgtgcttgttatcaaagcgcgcaaacttccacctttctttgcaagaaaactgaaagacgttcatgagactctaggcttcccagttgcatttgaatgccgcatcaatggctcagaacctcttcaagtgtcttggtacaaggatggggttcttttgaaagatgatgctaatttgcagacatcttttgttcataatgtagcaactcttcagattttacaaactgaccagagccacatagggcagtataattgctctgcttctaatcctcttgggactgcttcatccagtgccaagctcattctctcagagcatgaagtgcctcctttctttgatctaaagcctgtatcagtagatcttgctcttggagaaagtggtacttttaaatgtcatgtaactgggactgcaccaatcaaaatcacttgggccaaagataaccgagagattcgccctggaggcaactacaagatgactttggtagaaaatactgccactctgacagttctcaaagtaggcaaaggcgatgccgggcagtacacctgctatgcaagcaacatcgctggaaaagactcttgttctgctcagctgggtgtacaagaaccacccaggttcattaagaagctagaaccttcaagaattgtgaaacaggatgaattcacaaggtatgaatgcaaaatcggtgggtctccagaaatcaaagttttatggtataaggacgagactgaaattcaagagagcagtaaattcagaatgtcattcgttgactcggtggctgtgctggaaatgcacaatctcagtgttgaagacagtggagactacacctgtgaggcccacaatgcagcaggcagtgccagcagcagcacatccttaaaagttaaagaaccacccattttccgcaaaaagcctcatcctatagagacactgaaaggagctgatgttcaccttgaatgtgagcttcagggcactcccccatttcacgtttcttggtataaagacaagagagaacttaggagcggcaagaagtacaagataatgtctgagaacttcctaaccagtatccacatcctgaatgtcgatgctgcagacattggggaatatcagtgtaaagccacaaatgatgtgggaagcgacacttgcgttggttccatcgctctcaaagcaccaccaagatttgtgaagaagctcagtgacatatctactgtcgttggtaaagaagttcagctgcagactaccattgaaggcgctgaacccatttcagtggtgtggttcaaagataagggagaaatcgttagagaaagtgacaacatatggatttcttattcagaaaacattgcaaccttacagttttcaagagtggaaccagccaatgctggaaaatacacttgtcagatcaaaaacgatgctgggatgcaagagtgcttcgccacgctatccgttctcgagcctgcaacaattgtagaaaagccagaatccataaaagttaccacgggagacacctgtaccttggagtgtacagtagctggcacccctgaactcagtactaagtggtttaaggatggaaaagagctaacaagtgacaacaaatacaaaataagcttcttcaacaaagtatccggccttaagatcatcaatgtagcaccgagtgacagtggggtatacagttttgaggtgcagaaccctgttggcaaagacagctgcacagcttcattgcaggtttcagaccgaaccgttcctccttcattcacaagaaaattgaaagagacaaatggtctatccggctcctcagttgtaatggagtgtaaagtctatgggtcacctccaatctctgtctcctggttccatgaaggaaatgagatcagtagtggaaggaaataccagaccaccctgacagataatacttgtgctttaactgtgaacatgctggaagaatcagacagtggtgactacacatgtatagctactaatatggctggttctgatgaatgtagtgctcctttgactgtgagagaaccaccatcttttgttcagaaacctgatcccatggatgttttaactgggaccaatgtaactttcacaagtatcgtaaaaggaacacctcctttcagtgttagctggttcaaaggtagcagtgaactagtaccaggtgacagatgcaacgtgtctttggaggattcagttgctgaactggagttgttcgatgtagatacatcacaaagtggagaatatacttgcatagttagcaatgaagctggcaaggcttcttgtacaacacatctctacataaaagccccagccaaatttgtgaagaggctgaatgattacagcatagagaaaggaaaacccctgatcctagagggtacattcactggaactcctcccatttcggttacctggaagaaaaatggcataaatgtaactccttctcagaggtgtaatataactacgactgaaaaatcggcaatcctggaaattccaagtagcacagtagaggatgcaggacaatacaactgctacattgaaaatgcctctggaaaagattcctgttcagcacaaatactcatactagaaccaccgtattttgtcaagcagttggagccggttaaggtgtctgttggagattctgcctctctacaatgccagcttgctggaacccctgaaattggggtatcctggtataaaggagatacaaaattgagacccactacgacttacaaaatgcattttaggaataatgttgctacactggttttcaaccaggttgatattaatgatagtggagaatatatctgcaaagctgaaaacagcgtgggagaagtttctgcatcaactttccttaccgttcaagagcaaaaacttccaccatcattttctcgacaattgagagatgttcaagaaacagttggactgccagttgtttttgattgtgccataagtggatcagaacctatctccgtgtcttggtataaagacggcaagccattgaaagacagcccaaatgtacaaacatcatttttagacaatacagccacactcaatatttttaaaactgaccggagccttgcaggccagtattcctgcacagctacaaaccctataggctctgcttcttccagtgccaggctcattctcacagaggggaagaacccacccttctttgacatccgtcttgcccctgtggatgctgtggtgggagaaagtgctgactttgagtgccacgtcacgggcacacaaccgataaaggtcagctgggccaaagacagcagagaaatacgaagtggcggaaagtaccagattagttatctggaaaacagcgcccacctgacagtcctcaaagtagacaaaggagattctggacaatatacctgctatgctgtgaatgaagtgggaaaagactcttgcacagctcagctgaatataaaagagcggctcatcccaccaagtttcactaaaagactctcagagacagtagaagaaacagaagggaattctttcaaacttgagggacgtgtggctggttcccaacctataactgttgcctggtacaaaaataatatagagatacaaccaacttctaactgtgaaataacattcaagaacaacacgttagtgctgcaagtcaggaaagcaggcatgaacgacgctggtttgtacacatgcaaagtgtccaatgatgcaggctctgctctgtgcacgtcttcaatcgtcatcaaagaacctaagaagccacctgtatttgatcagcaccttactccagtaacagtgagtgaaggagaatacgtgcagctcagctgccatgtccagggatctgagccaattaggatccagtggttgaaggctggcagggaaataaagccttcagacagatgcagcttcagctttgctagtgggacagctgtactggaactcagagatgtggctaaagcagattcgggagattatgtgtgtaaagcttcaaatgtggctggaagtgacactaccaaatcaaaagtgaccattaaagacaaaccagctgtggccccagcaaccaagaaagctgcggtagatggaagactcttttttgtgtcagaacctcagagtatcagagtcgtagaaaaaaccactgcgaccttcattgcaaaagttggaggtgacccaatcccaaatgttaaatggacaaaagggaagtggagacagctgaaccaaggaggtcgtgttttcatccaccaaaaaggcgatgaagcaaaactggagattagggacaccacaaaaactgattctgggttataccgatgcgtggcatttaacgaacatggtgaaattgaaagtaatgttaacttacaggtggatgaaaggaagaaacaagagaaaattgaaggcgatcttagagcaatgctgaaaaagactccaatcttaaagaaaggagctggagaagaagaggaaattgatatcatggaacttctcaaaaatgttgatcctaaagaatatgaaaaatatgcccgcatgtatggaatcactgacttccgaggtcttcttcaagcatttgaactgctcaagcaaagccaagaagaagagacacatagactggaaattgaggaaatagagaggtcagagagggacgaaaaggaatttgaggaacttgtatcatttattcagcaaagactgtcacagacagagcctgtcactctgatcaaggacattgaaaatcagacagttttgaaagataatgatgctgtctttgaaattgacattaaaattaattatccagaaatcaagctttcgtggtacaaaggaactgaaaaactggaacccagtgataaatttgaaataagcattgatggtgaccgacatacactcagagtcaaaaactgtcaacttaaagaccagggcaattatcgattggtttgtggtccacacatcgctagcgctaaactaactgtaattgagcctgcatgggaacggcatcttcaggatgtgactctgaaagaaggccagacttgcaccatgacatgccaattttctgtaccaaatgtaaaatctgaatggttcagaaatggcagaatccttaaaccccaaggtagacataaaacagaagtggaacacaaagtccataaattgaccattgcagatgttcgagcagaagaccagggtcagtacacctgcaaatatgaagaccttgaaacttcagcagaactcagaatcgaagctgaaccaattcagtttacaaagcgcatacagaacatcgtggtgagtgagcatcagtctgccacctttgagtgtgaagtgtcctttgatgatgccattgtaacatggtacaaaggaccaacagaactgacagagagccagaaatacaacttcaggaatgatggccgctgccattatatgaccatccacaatgtgaccccagacgatgaaggtgtctactcggtcatcgctcggctggagccaagaggtgaagcaagaagcacggcagagctgtacctaacgacgaaagaaatcaaacttgagctgaagcctcctgatattcctgactccagagttccaatcccaaccatgcctatcagagcagtgccaccagaagaaatccctcctgtggttgctcctcctatcccccttttgctaccaacacccgaagaaaagaaaccaccaccaaaacgtattgaagttaccaaaaaggctgtgaagaaagatgccaaaaaagttgttgcaaagcccaaagagatgacaccacgtgaagagattgtcaagaagcctccacctcctactaccttaattccagcaaaagctcctgaaatcattgatgtatcctctaaagctgaagaagtaaaaataatgactataaccagaaagaaagaggttcagaaagaaaaagaagctgtgtatgagaaaaagcaagcagtccacaaggagaagagagtcttcattgaatctttcgaagaaccttatgacgaactggaggtagaaccatacacagagccatttgaacaaccttattatgaagaaccagatgaagactatgaagagattaaggtagaagctaaaaaagaagttcacgaggaatgggaagaagattttgaagaagggcaagaatactatgaaagggaagaaggctatgacgaaggggaggaagagtgggaagaggcttaccaagaaagggaagtaattcaagttcaaaaggaggtctatgaagaatcacatgagagaaaagttccagccaaagtacctgaaaagaaagcaccaccacctcctaaagttataaagaagccagtaattgaaaaaattgaaaagacttctcgaagaatggaggaagaaaaagttcaagtcaccaaagtacctgaagtttcaaagaagattgttccacaaaaaccttcccggactccagtacaggaagaagttattgaagtgaaagtaccagctgtgcatacaaagaagatggttatttcagaagaaaagatgttctttgcttctcacacagaggaggaggtgtcagtcacagtccccgaggtacaaaaggaaattgttactgaagagaaaattcacgttgccatttccaaaagggttgaaccaccacctaaagtccctgagctacctgagaaaccagctccagaagaagtggcccctgttcctatccctaaaaaagtggagcccccagcaccaaaagttcctgaggttcccaagaaacccgtgccagaggagaaaaagccagttcctgtgcctaagaaggaacctgctgctcccccaaaagtcccagaggtgccaaagaaacctgtccctgaagaaaagattcccgttcctgttgcaaagaaaaaggaagctcccccagctaaagttcctgaagtacagaagggagttgtgacagaagaaaaaataaccattgtaactcaaagagaggaatctccaccaccagcagtgccagaaataccaaagaagaaagttcctgaagaaaggaaacctgttcctcggaaggaggaagaagttccaccaccaccaaaagtgccagctctgcctaagaaacccgtcccagaggagaaagttgcagtgccagttcctgtcgctaagaaagctcctcctccccgagctgaagtctctaagaaaactgttgtagaagaaaagagatttgttgctgaagaaaaactatccttcgcagttcctcaaagagtggaagtcacgcggcacgaagtatctgcagaggaggaatggagttactcagaagaggaggaaggtgtgtccatttcagtttatagagaagaagaaagagaggaggaggaagaagcagaggttacagaatatgaagtgatggaagagcctgaggaatatgttgtggaagaaaagctgcacattatttctaagagagtggaagctgagccagctgaagtgacagagaggcaggagaagaaaattgtactgaaaccaaaaattcctgctaaaatagaggagcctccaccggctaaagttcctgaagcacctaagaaaattgtgccagaaaagaaagttcctgctccagttcctaaaaaggaaaaggtgc

SEQ ID NO: 191439 - DNA, 32767 bp, Homo sapiens; identical to SEQ ID NO: 191437
  Payload ID: 17810
  Gene Name: titin
  Uniprot ID: Q8WZ42
  ENST ID: ENST00000615779
  CDS Start-End: 226-103278

SEQ ID NO: 191440 - DNA, 1548 bp, Homo sapiens
  Payload ID: 17810
  Gene Name: titin
  ENST ID: ENST00000634225
  CDS Start-End: 1-1063
gtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccgtgatatccggaagaccacagcccaaaatttcctggtacaaggaagagcagctgctttccactggcttcaagtgcaaatttcttcatgatgggcaagaatacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctagtaatgctgtaggccaagtatcaagcacagccaacctgagtctggaagcaaaagaatcgcaagccagagcacttacaaaaattactctgggttctgacactaaaagtattaaaacactcagagagtcacaaattaaaacaacccgtgaagtaaaaagagaatcgtcaaagaaaacatcaagtttgtcattaacttcatgccaaaaaccgtaagaaactgagaacaagggaataaagtctactgacaggataccacgtggactgaagactgagagtgatacgagagccccagcctttcccaaggagctgccctagatatgactgtgtctaaaagctgtgcatattccttgtggaataaaaacagttttgataagtctttgttttgtttcttaatatgtaatttggacttcatgtagttcaaagtttgaaaggtgattcaaatcaaaggagtgtttactagcaggaaaaactgagaatagccctctgctaaagtagcaatttagaaaatgcatgttctttctaaatgtgatttcatctcttagcaagtgtttagtcaataggacattttttagaaaataatattccttcggtttgtagattgctttctgcatgcatgtaaaggcatggggaattatagaactaaaagtggaaatttcatgaagaacctaaaataaaaatgttttaaatctttctgtcaa

SEQ ID NO: 191441 - DNA, 2123 bp, Homo sapiens
  Payload ID: 17811
  Gene Name: titin-cap
  Uniprot ID: O15273
  ENST ID: ENST00000309889
  CDS Start-End: 1174-1677
atatgaagaaccggggacagtgctcagtaatcaatagtctgcagttctgcacccacgtgctcctgggtactctgccgtccccacagggtcctcagctcagcccctgtcactgcctctcctgccaccctttgtccactcggcagtgttctcactcctcatccccccacacccaccacctgtctgccagcctcttgcaccatgagttgctactcctggggtgctggactgtccccacagccatctgtctcccctgctccccatgaagaagagccagtcccctcccaggtagcacatcagagcgggcaggctccagagctcttctggtcctcttgcagtggccagaaagtggggaaaggggcccagagaggggcagggactgacccatggtcacacagcctatttatggctgatctggagccaggccttctgactatcacccatcagagcccctggattcccatttcacccaacacaggtgttggggtagaactgggggccctccacccctactagcctgactgtctcctgagacctgtctcctaagaccacttacctgaccactggccatggggaaggaaaacacctggccaaggctcatgccccaggttcccaggcatgaagttgactgtctccgcccctgctggtgtggtgagggtgactggggactaggcactaggcctttggtgcaggcgcctgaggacgtggttgcactctcccttctggggatatgcccttgagcccaggcagaggagagcacagccagggcaggacctggcagccctggtacagagcccagagggggcatcagttcctgctggtcctgctctgtttacagacaagctgctgtcctccctgcaaaggggagtgggtggggcagagggcaagtgccaggggggcacaaggctgggcatgtggctggcatgagacggtgtctgagtaatgtcaggcacctggaggcattgaccccaggaccttggaccccagacctctgaccggggggcagccagcgtccaggtaccccaacccctgccctgggtccggcgtccccccattagtgagtcttggctctacttatagcatctgacaccagaggggccgaaaatagcccctggagaagggggaggagggggctatttaaagggcctgggaggggagagagaatgaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtgggcactaagggtggagagttgggggccagcacagctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccagag

SEQ ID NO: 191442 - DNA, 583 bp, Homo sapiens
  Payload ID: 17811
  Gene Name: titin-cap
  ENST ID: ENST00000578283
  CDS Start-End: 12-443
gaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcacttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggcc

SEQ ID NO: 191443 - DNA, 1017 bp, Homo sapiens
  Payload ID: 17812
  Gene Name: TLC domain containing 1
  Uniprot ID: Q96CP7
  ENST ID: ENST00000292090
  CDS Start-End: 112-855
ggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtactcctctgaa

SEQ ID NO: 191444 - DNA, 784 bp, Homo sapiens
  Payload ID: 17812
  Gene Name: TLC domain containing 1
  Uniprot ID: Q96CP7
  ENST ID: ENST00000394933
  CDS Start-End: 125-727
ggcaaatcggaggtcttgcttgcccagcctccggggagccgggccgagggccgggactgtctgagggaggactgtgacagccgcccggccccaggagtttaagagccggcgggaagaggtggcgatgggttactcagcagttcccaagtgcccacctcgcgggcgcgggagggacagtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatgga

SEQ ID NO: 191445 - DNA, 578 bp, Homo sapiens
  Payload ID: 17812
  Gene Name: TLC domain containing 1
  ENST ID: ENST00000580518
  CDS Start-End: 137-578
aaaaactcagtattcggccaggcgcggtggctcacgcctgtaattccagcactttggggaggccgaggcgggcggatcacctgaggtcaggagtttgagaccaacctggccaacatgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatca

SEQ ID NO: 191446 - DNA, 408 bp, Homo sapiens
  Payload ID: 17812
  Gene Name: TLC domain containing 1
  ENST ID: ENST00000581236
  CDS Start-End: 1-161
tcggtgggggtgtcttaacactactggtggaagtcagcaacatcttcctcaccattcgcatgatgatgaaaatcagtaatgcccaggatcatctcctctaccgggttaacaaaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagta

SEQ ID NO: 191447 - DNA, 5971 bp, Homo sapiens
  Payload ID: 17813
  Gene Name: TLC domain containing 2
  Uniprot ID: A6NGC4
  ENST ID: ENST00000330676
  CDS Start-End: 197-991
cggctgctccaatcaccgcccaggcgagggactgggcgtggacgaacggggaaaagttcctgctgatcccaaaggcgcggcggggaggggagccggggccccagccctgccgggaaacgggttcccagtcccggccgagagcgcgggcgccgaggggaccgacccggactccccgcaaccccccaaccgccaggccatggcgcccacggggctcctggtggccggcgcctccttcctcgcgttccgggggctgcactgggggttgcggcggctgcccacgccggaatcggccgctcgggaccgctggcagtggtggaacctctgcgtctccctggcgcacagcctgctctcggggaccggggcgctgctcggcctgtcactgtaccctcagatggccgccgaccccatccatggccacccgcgctgggctctggtgctggtggctgtgtctgtgggttacttcctggcagacggagctgacctgctgtggaaccagaccttgggcaagacctgggatcttctctgtcatcatttggtggtggtgagctgcctcagcaccgctgttctgtctggccactacgtgggcttctccatggtgtctctgctcctggaactgaactctgcctgcttgcacctgcggaagctgctgttgctttctcgccaggccccatccctggccttcagcgtgaccagctgggcctccttggccaccttggccctcttccgcctggtcccgctggggtggatgagtctgtggctgttccggcagcaccaccaggttcctcttgctctggtcaccctgggtggaattgggctggtcactgtgggcatcatgagcatcatattggggatccgtattctggtcaatgatgtcctacagtctcgaccccatccacccagccctggccatgagaaaaccagggggaccaggacacgtcgtgacaatggacctgtcaccagcaacagttcgactctcagcctgaaagactagagagaagccatgggcccctcgctgggggaggtggggccaggacaaggagatgagggtcttccatgcacagtcccccatcagggtgagggccagacttgctcatcagaatctcagtttctcttccagctaactcacatcccttccccttcctcggatctaagaagaaatgctgatgttggatgggtgggaacctgggtttctgttcactgaaatccgtcatcagatgagcatcctttccagcaaataaactcaagaggtacagctagagctatcagtaaagggtggcaggaggcatgcagctggaagaaactgccagtggagacagaagctctttgctttaacccagggacagatgggggaaggtgaagtcccactaggatcagagagatctggtatggggcgggtggggacagagagaaaagagatctcacctataaccaaattctggcagtgggaggaaggtagaggaggtgctatctgtagcagcagagatggacgtgatagttgccaagagacagaacctgggccacagcaattgctgctgatgtttctggttctcaaagccacactcctgtttttctttttctttttctttttttttatgagacggaatcttactctgtcacccaggctggagtgtagtggcacgatttcggctcactgcaacctcagcctcctgggttcaagtgattgtcctgccttagcctcccgagtagctgtgacttcaggcatgcaccaccaagcccagctaatttttgtattttttggtggagaggaggtttcaccatgttgcccaggctggtctcgaactcctgacctcaagtaatccacctgcctcggcctcccagagtgctgggattacagacgtgagaacaggcgcacactcctgtttttctccttaaccctggtcctgctgtgtctagccttttatttttatttttatttttagtatcttttgacttttcttttttcttttctttttttttttttttttttgagacaagttcttgctctgttgcccaggatggagtgcagtggcttgatcttggctcactgcaatctctgcctcccaggctcaagcaattctcctgcctcccacctcagcctcccaagtagctgggactacaggtgcacgccactgcaccaggctaatttttgtatttttttgtagagaccaggttttgccatgttgcccaggctggtctcaaacttttgcactcaagtgatccacccacctcagcctcccaaagtgctgggattacagacgtgagccaccgtacccgaccccttttgacttttcaaagacaattcggattcttagaggaatgaacacagggctggtttgtcttcttaggacggcactgaagtctagaattacagaaggaaaggtgcccagtacagagttttcccaggcccaggctttcatggaagaacaagggcagaggtagactgtgtgagagaaggctgcaggaggataaaggaatagctggccctctggctgggcgcagcagctcacgcctgtaatcccagcactttgggaggccgaggcgggaggatcacctgaggtcaggagttcaagaccagcctggtcaacatggtgaaaccctgtctctactaaaaatacaaaattagccgggcatggtggtgcatgcctgtaatcccagctactcaggaggctgaggcaggagaatcgcttgaacccaggaggcagaggttgcagtgagccgaggtcgtgccactgcactccagcctgggcaaacagagtgagactcttgtctctaaagaaaaaaaaaaaaggaagagctgggacttttctgagatacattcataaagtcttcttcctccctgctgcttctgctgcgtttttttctgttgaacaagaccccttccttcccagaacatcgaggtgacgggaagtgcccagcagattaagtctgctgttccactaaacaatggactgagagaggcaacccttagccatccacagaaaagctacatgagcaaaagcaagagacaggaagattgtcttcaaaaaaaaacaaaacaaaacaaaaaccttgctaagaagcggaggtacagaaagatacgaagaatgacagagacagacatacatagattgagtgatagatagaaagagagaaggattattcacatagaggtgacagaggcaaagaaggatggagggcaaaagagacaggccctagcagaaatatggagaaaggctgtcatagatcctgagagacaccaaagtcacagaactgataaaagggttataaacaaaaaggaccagaaaaatagaaatgaaggccgacaagaagagaccccaaggctgaaaggcacagagagtctagacagtgaaatagagtgagtgacaaggagaaacacccaggctcaggagtgatggaggaaatactggcagatagagagatcagaagagcaagaggagaggtgggaacagagaagagcggggacgagtccggggagctgagaagcagaaggcggaggaggcagtcagtgggaagattcactgacagaagagaccaggagatatggggacttggaggcaggcagaaagacaaaggacaaacagctgcagcgcaaaccctaaagacaggctgacagtaaccggtcggcagagactggtaggaagataaggacaagtcagaatcaggggtgtcaactgagatgcaaatataggcaaaggagctgacaaagagaatcacagagagaaaaaaaaggaggagagcacagaacaatttaaatatccaggctgggcatggtgggtcacgcctgtaatcccagcattttgggaggccgaggcaggcggatcacgaggtcaggagatgaccatcctggctaacatggtgaaacaccatctctactaaaaatacaaaaaattggccgggcgtggtggcaggcgcccgtaatcccggctactgaggaggctgaggcaggagaatcgtttgaacctgggaggccgaggttgttataatgagccgagatagtgccactgcagtccagcaggggtgacagagtgagactccgtctcaaaaaaaaaaattgaatatccaaagaacaaagaagaggcaggaacccagaaatgaaaagaggaggaaaaatacaggtgtgaaaaaaaaatgagagggattgtgagaagtctccatcatagagtcataaaaacaggcgcaaaggatgaaaatacatcgagactgaggaaaacacagttggaaggagctaaacacaagcagaaaataagagcagagcatttaaatgtaattagataaaaacccaagaggcaaaggtatagatagtgagctagagaaacaatgcagaattttgtcagagtctgtacttctagaagtcatgtttgctggctgggcatggtggctcacgcctgtaatcccagcactttgggaggccgaggtaggaggagtggttgagctcaggagttcaagaccagtctgggcaacatattgagacctcctctctacaaaaaaaaaaaattttcttttttctttcttttcttctttttttttttttttttttgagacagtttcattcttgctgcccaggctggaatgcagtggcacaatcttggctcactgcaacctccacctcctggactcaagtgattctcctgcctcagcctccctagtagctgggattacaggtacccaccaccacactcggctaatttttgtgtttttagtagagacaggatttcaccatattggccaggctggtctcaaactcctgacctcaggtgatccgcccaccttgggctcccaaactactgggattatatgcgtgagccaacacacccggccaaaaaaaaatttttaattaaaaaaaaaagtcatatctgcaaaactcaatttgccatcttaactgaatgccttgattaacaaaaatgttgtctgccttgagtttttaaagaaaaagaaatatgacaaactcatgtgaggaatctattccttaaatatctgttgaggttgatatgaattgattctaagtcatacaccttttctttggccactggtatacattcatgatggtttgagtgagtgtcccttttggtaatacttgatagtgtctatgaggccgggcgtggtggctcacgcctgtaatcccagcactttgggggaccgaggcaggtgaaatcccatctctactaaaaataaaaaaaattagccgggcgtggtggcgggcgcctgtagtcccagctactcaggaggctgaggcaggagaatggcatgaacccgggaggcggagcttgcagtgagccaagatcgtgccactgcactccagcctgggtgacagagcaagactccgtcttaaaaaataaataaataaataaatagacagatagatagatagatagtgtctatgaaggctgcccaagaacttgaccattagggaaacatggctgtttctgtggattaactagtcaagcccatacaggaagagtgaggtcagctcccaggtggggcaggatgtagtggacgcttggaagaatttgggaccacacacgaattgctaccatggtgagccagtgaaacttgaggaaggcaggactggattgtgattacaactgagtaagtaggcagagaattggagtgtgggcaacataaagatgatgtgaatcaaagaagaatggtcaattaagaccctaaaaaaaggacgttcaaaaatgcagaggttaaaaaaaaaaaaagcagagattgccagatgctccatttggtaggagtctgcttagcacagtggtgcttcgccagactttaccgtggcccagggaaatggtcctcaagacggactccatgtctaccaagctacttgctaatgatttctttgtcctccaggacagggaaggggcttttctggatgggatacattgatattttatggccttgaaacactatcctgattataaattaataaattgctatgcaaataattgcattagttgcatcaatctcttat

SEQ ID NO: 191448 - DNA, 5971 bp, Homo sapiens; identical to SEQ ID NO: 191447
  Payload ID: 17813
  Gene Name: TLC domain containing 2
  Uniprot ID: A6NGC4
  ENST ID: ENST00000611774
  CDS Start-End: 197-991

SEQ ID NO: 191449 - DNA, 4935 bp, Homo sapiens
  Payload ID: 17814
  Gene Name: TLR4 interactor with leucine-rich repeats
  Uniprot ID: Q7L0X0
  ENST ID: ENST00000539664
  CDS Start-End: 247-2682
cagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacaacctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgccctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataa

SEQ ID NO: 191450 - DNA, 1250 bp, Homo sapiens
  Payload ID: 17815
  Gene Name: TM2 domain containing 1
  Uniprot ID: Q9BX74
  ENST ID: ENST00000294613
  CDS Start-End: 304-927
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcac

SEQ ID NO: 191451 - DNA, 1248 bp, Homo sapiens
  Payload ID: 17815
  Gene Name: TM2 domain containing 1
  ENST ID: ENST00000371180
  CDS Start-End: 118-927
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattc

SEQ ID NO: 191452 - DNA, 637 bp, Homo sapiens
  Payload ID: 17815
  Gene Name: TM2 domain containing 1
  ENST ID: ENST00000468586
  CDS Start-End: 1-160
actcgttggtgtcctgtggttcgtctcagtcactacaggaccctggggggctgttgccacctccgccgggggcgaggagtcgcttaagtgcgaggacctcaaagtgggacaatatcctctgtggagaacacccccccatggaggcgagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcaggctggagtgcagtggcgtgatcataactcattgcagcctcgaattcctgggttcaaacaatcttcctgcctcagcctcccatccagtatgggatattttaaaagattgttggaccttcagatggaagtagttacattatagattactatggaac

SEQ ID NO: 191453 - DNA, 3218 bp, Homo sapiens
  Payload ID: 17815
  Gene Name: TM2 domain containing 1
  ENST ID: ENST00000371177
  CDS Start-End: 14-574
gtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtaaggaaactgtcaccagagaggttaagggatttactgagtctagaggctttcctttattctgtgacatatttgttgttatcatctttgttttatggataggaaaattgtcacgagattaagagatttacccaaggacactcagctagtgacctcaatttgaacccaaattttctggctccagagatcatgctttatttactgtagtactctgcttctatattagcccttcactgagcaaatttaaagtttttgaatgctctgcctactagctagcaaagctaaccttatttcttccatgttgctacccacaaaagatgaaagagaagtcttcactgtggggttgatggtagatatatttctgacagctatactaaaactcagtgttgtaagttcctaagtaaaagtcatgaagtactatatatacttgtttagttaattaaacatatattcaacatttaaataactaagtgatatggaaataatgatgaaggtcacagtgtatattggttaaaaataaaataaatatgttagtaggccaatttatggtacagcgctgtaacagaaccataaccgtgctgtgagagtacagaaaagggactgatgcagttgacttaaggaagttcttagatatggtgacatttgagctagggtttgaaggatgaaaagattacagaggttgaaggcattgcagagaacagcatgtgtaaagcatatagtgtacactgggagattaggggacaatttagctgatcgtgtaggaagaacaatgcaggaggtgacactgcctacagaggtagtctatggtccgattataaaatgctttgagtatcttgctatggagttgggtcctttagatatcaaaagttatccttttaggtatcagaagcaatagaatattttttctttttctttcttttttttttgtgtgacagagtctcactctgttgcccaggctggagtgcagtggtgcgatcacggctcactgcaacctcgacctcctgggctcaaggtatgctccgtcctcagctctgccccaagcagctgggactacaggcatgtaccaccatgcctgacttatttcggtatttttctgtagagatgggattttgccgtgttgcacaggctgctctagaactcctgggctcaagctgtcctctcacctcagcctcccaaagtgctgggattacagggatgagccacagtgcctggccaatttaaaatttttaagtattttaaataaattgtaatttctattaagaattcaaggttaaggaatttaggcatttttattttaaatgatcactgcctcaaaaaaaattcttaactacgtaatacaatgttgactgcaatgaaagtagttatagacaaaatctaaaattcaattttttgctgggtgcggtggtgtgtgcccatagacttagctactcaacaggctgaggttgggggattgcttgaggccaggagtttgaggccagcagagacaacatagtgacatagtgagatcccatttctacaaaaaagaaaaaaaaaaatcccattttacaactaaccttacttagtctttcttcatggttatgaaaagcagtggtcctacttatattagctttttttttttccttcatagtgctaattataaatctgttagcctcggggatttgtttattcattcatttcagtcttcctctggaatatacattcttttttttttttttttaggcggagtttcactcttgttgcccaggatagagtgcaatggtgcgatcttggctcaccgcaacctctgcctcctgggttcaagtgattctcctgcctcagcctcccaagtagctggattacaggcatgcgccaccatgcccagctaattttgtatttttagtagagacagggtttctccatgttggtcaggctggtctcgaactcctaacctcaggtgatctgtctgcctcggcctcccaaagtgttgggattacaggcgtgagccactgcgcctggcctggaatgtacattcttaaaggcagaggccttatctgtcttaggcaagttggtatcctgaacagaacctgacagtaagactctgataaatatttgtcatatgaatatcaaaaaaaactagaaacaggctaaatgttcagtagggaggaactgtctaaaaaaattaaggtacagtgcgtaacacaacagaatactatgcagccatttaaaacaatcacatagaaatatgtttattgggaaagtaatgtaataacacccataacagagtaagatgataaatttaagaaaatctagatactttgctacagaacactttcttagggatgcttcacaaaaatgaacatgagaggtttctgctaagataaaatattggataagggaataatatctttgtttggaactggtaaatattacctactcctggagtaatacatttaaggaaactagagaacagatcagagataatatttaaaagtttaaggaactaacaaatttatagtgacagaaagcagataagtgcttgctggggaaagacgggggcaaggagagacaagaagtagaaattacaaaggggcatgaggaaactattgggtgtgacagatatgttctttttttattatagtgattgtttcacaggtgtttacaagtgtcaaatttatcaaattgtacattttaaatatgtacagtgtatgtcattgcatgtcatttaggtcattgtatgtcattttaatgtatgtcatttataactcaataaagctgttttaaaaaatc

SEQ ID NO: 191454 - DNA, 577 bp, Homo sapiens
  Payload ID: 17815
  Gene Name: TM2 domain containing 1
  ENST ID: ENST00000496465
  CDS Start-End: 25-255
ggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatcctctgtggagaacacccccccatggaggcgaggtagagttggggtcgcagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgca

SEQ ID NO: 191455 - DNA, 969 bp, Homo sapiens
  Payload ID: 17815
  Gene Name: TM2 domain containing 1
  Uniprot ID: Q9BX74
  ENST ID: ENST00000606498
  CDS Start-End: 22-645
gagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcaca

SEQ ID NO: 191456 - DNA, 544 bp, Homo sapiens
  Payload ID: 17815
  Gene Name: TM2 domain containing 1
  ENST ID: ENST00000494926
  CDS Start-End: 1-233
ggttcgtctcagtcactacaggaccctggggggctgttgccacctccgccgggggcgaggagtcgcttaagtgcgaggacctcaaagtgggacaatatcctctgtggagaacacccccccatggaggcgagggtcttactctgtcgccctggctggagtacagtggcacgatctcagctcactgcagcctccgcctcccgggttcagtcaattctcctgcctcagcctcctgagtagctgggactacaggcatgcgccaccacacccggtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcag

SEQ ID NO: 191457 - DNA, 921 bp, Homo sapiens
  Payload ID: 17815
  Gene Name: TM2 domain containing 1
  ENST ID: ENST00000488206
  CDS Start-End: 1-314
ccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatcctctgtggagaacacccccccatggaggcgaggtagagttggggtcgcagggtcttactctgtcgccctggctggagtacagtggcacgatctcagctcactgcagcctccgcctcccgggttcagtcaattctcctgcctcagcctcctgagtagctgggactacaggcatgcgccaccacacccggatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtgg

SEQ ID NO: 191458 - DNA, 1631 bp, Homo sapiens
  Payload ID: 17816
  Gene Name: TM2 domain containing 2
  Uniprot ID: Q9BX73
  ENST ID: ENST00000397070
  CDS Start-End: 589-1104
agttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgg

SEQ ID NO: 191459 - DNA, 3295 bp, Homo sapiens
  Payload ID: 17816
  Gene Name: TM2 domain containing 2
  Uniprot ID: Q9BX73
  ENST ID: ENST00000456845
  CDS Start-End: 256-771
ggggttgtggttgaggccgggtctccgctcctgtgcccgggaagatggtgctaggtggttgcccgaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 191460 - DNA, 3263 bp, Homo sapiens
  Payload ID: 17816
  Gene Name: TM2 domain containing 2
  Uniprot ID: Q9BX73
  ENST ID: ENST00000456397
  CDS Start-End: 95-739
ctacgcggaaaggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 191461 - DNA, 549 bp, Homo sapiens
  Payload ID: 17816
  Gene Name: TM2 domain containing 2
  ENST ID: ENST00000520152
  CDS Start-End: 415-549
aaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggat

SEQ ID NO: 191462 - DNA, 885 bp, Homo sapiens
  Payload ID: 17816
  Gene Name: TM2 domain containing 2
  ENST ID: ENST00000522142
  CDS Start-End: 524-885
ggatttctaaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttgg

SEQ ID NO: 191463 - DNA, 570 bp, Homo sapiens
  Payload ID: 17816
  Gene Name: TM2 domain containing 2
  ENST ID: ENST00000517872
  CDS Start-End: 383-570
agttcttgggtctgtgctgctggcctggggttgtggttgaggccgggtctccgctcctgtgcccgggaagatggtgctaggtggttgcccgaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaaggt

SEQ ID NO: 191464 - DNA, 1329 bp, Homo sapiens
  Payload ID: 17817
  Gene Name: TM2 domain containing 3
  Uniprot ID: Q9BRN9
  ENST ID: ENST00000347970
  CDS Start-End: 31-696
ccggcccggaagtgcgcaggcgctggcaagatggcgggaggggtgctcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaata

SEQ ID NO: 191465 - DNA, 1381 bp, Homo sapiens
  Payload ID: 17817
  Gene Name: TM2 domain containing 3
  Uniprot ID: Q9BRN9
  ENST ID: ENST00000333202
  CDS Start-End: 7-750
ggcaagatggcgggaggggtgctcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaa

SEQ ID NO: 191466 - DNA, 1267 bp, Homo sapiens
  Payload ID: 17817
  Gene Name: TM2 domain containing 3
  ENST ID: ENST00000428002
  CDS Start-End: 16-567
gcaggcgctggcaagatggcgggaggggtgctcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagtaatatatcctttccgaggctcatcttcattccaaacgttccacatttccttctgttatcatttattttctgtcggaattacttcctccagcaaaaaaatttttaaggcagttctgctggtaacaaattttcttagattttcttcatctgagaatatctttatttcaccctcatacttgaaagttagttttgccaaacatagaattctgggtgacagtttttctttttctttcagcacttgaaaagtcttatgacacgtccttctggccttcatgatttctgctg

SEQ ID NO: 191467 - DNA, 1734 bp, Homo sapiens
  Payload ID: 17817
  Gene Name: TM2 domain containing 3
  ENST ID: ENST00000561373
  CDS Start-End: 558-1106
tgtggcttatcgaagtaccagtgtgaaataatgacattttaaagttgatgccctgaggatgtcagtggcttcatttctgaattagtgaattcagatgaaaagaacacgggattggaaatggagagatttgggttctagttccagttttgccacagacttcctctgtgattttgcaaaaccctactgtaagttttttttcaacttacaaaatgatagtcttttttttaagcccttaatgtatacccagaattttctatacattatttgtatatgagcacctttagttttcacggccacgtgggaggcaggaatgaagtaatgttttacaagtgtggtgctcaccaggtcccacagctggccgtgggcagaattctgctttaattgcaggtgtctctgactccagtcccatgcttcttcccttccagtgcagtgtctacttgctaatgatcacgtctcttaaccttagaagattgttctctgttattcgaatcagtattataggagaataagcttctctcttgcctctcacagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaag

SEQ ID NO: 191468 - DNA, 1868 bp, Homo sapiens
  Payload ID: 17817
  Gene Name: TM2 domain containing 3
  ENST ID: ENST00000560013
  CDS Start-End: 31-159
ccggcccggaagtgcgcaggcgctggcaagatggcgggaggggtgctcccgctgaggggcctccgcgccttgtgtcgcgtgctgctcttcctctcgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataaggttttcttgtcccgggataacgtgtttctctaattgtacgatccttaaatttagagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagag

SEQ ID NO: 191469 - DNA, 864 bp, Homo sapiens
  Payload ID: 17817
  Gene Name: TM2 domain containing 3
  ENST ID: ENST00000558129
  CDS Start-End: 1-485
aaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagagttggactcttcatcgacactgtgaccacaccactgcactccagcctgagccacagagcgagacactgtctctaaaaaataaaagaaaaagaaaacacaataacaagtattgatgagaatgtggagaaattggaaccttcatatattgctggtggggatgtaaagtgatgtagctgcccaggaaaacagtctggcaatttgtgaaaatgttaaacatagagttaccatgtgacttggggaatcttctaggtatacacccaagagaagtggagatatgttgtgaaagttgtcagcaccaaaatggggtcacttaggtcaaaccctagcaaaatgaatccgggaggccctgaaggaggagtactcacgcacatgtacctatgataagaactattacaaggactccctggaaaccataaacactccatgttaagctgctgctgtgaagacatctccc

SEQ ID NO: 191470 - DNA, 1353 bp, Homo sapiens
  Payload ID: 17817
  Gene Name: TM2 domain containing 3
  ENST ID: ENST00000559107
  CDS Start-End: 24-653
ggaagtgcgcaggcgctggcaagatggcgggaggggtgctcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagtctgcaggcccaggtggggcttcatgttcagctcactgttggacttcattgacatcaccctgaaaaaggtggatttttgaggagcgtgagaagaagagcatgagaagtgctgaattacactgtgttgttgcagatgagcgtccctaaccacagcagtccttgaagaagaaagatggtctgataggaactgcttattcaggaacacattgcaaaatctgtgggtgtccttcgggatctgagggcctcactcctacaactgcaaggaattgaattcttctaacagtgtgatgaggttggaagaagactccaagatccagaaaggaacacagtcccaccaacacctgtgttgtaacctggtgacaccctgaaacagagaatccagctaagcgatgcccaaaatattcatccacaacgtgttgttttaagcttccaagtttctagtaatttgttataaagcaatagaaaagtaatatatcctttccgaggctcatcttcattccaaacgttccacatttccttctgttatcatttattttctgtcggaattacttcctccagcaaaaaaatttttaaggcagttctgctggtaacaaattttcttagattttcttcatctgagaatatctttatttcaccctcatacttgaaagttagttttgccaaacatagaattctgggtgacagtttttctttttctttcagcacttgaaaagtcttatgacacgtccttctggccttcatgatttctgctg

SEQ ID NO: 191471 - DNA, 878 bp, Homo sapiens
  Payload ID: 17817
  Gene Name: TM2 domain containing 3
  ENST ID: ENST00000558677
  CDS Start-End: 1-65
cgcagttctgcattctgtcgggcggtggtgagtcaaaggctgggttcagcgccgggtggggctgagtggcagcagggccccgggagctgcgaggaggccgggcccacgggcggacgctgacgcggggaggaggccgagtgccgggctccgggccgcttgtcgctgcatctggagtctggcgccctggccgcccggcccgaggccgcccctccgctccggcgacaccgagcccgccatcgcggctgcggagccctggcacggagatggagcgcttgggggctgggccggggaggcggaactggagcgcgatgtcatccttcggtccctcgttgccggctgacctgaactgatgtctactctgttgacgtttcgtccctaagctttgtgttttctggctgaccagccgtgaggttttcatgagcagcttattggcctggtgtagacccgccgtgttaaccacacaaaataagaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaa

SEQ ID NO: 191472 - DNA, 964 bp, Homo sapiens
  Payload ID: 17818
  Gene Name: TM4SF19-TCTEX1D2 readthrough (NMD candidate)
  ENST ID: ENST00000442633
  CDS Start-End: 112-741
gacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggttcaggccctctgtggttaaagactgtatccatgctgtgctcaaggaggaactggcaaatgctgaatattctccagaagaaatgcctcagcttacaaaacatttatcagaaaacattaaagataaattaaaaggtaatcatggtgataa

SEQ ID NO: 191473 - DNA, 3491 bp, Homo sapiens
  Payload ID: 17819
  Gene Name: TMED7-TICAM2 readthrough
  ENST ID: ENST00000282382
  CDS Start-End: 370-1584
cggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttga

SEQ ID NO: 191474 - DNA, 3453 bp, Homo sapiens
  Payload ID: 17819
  Gene Name: TMED7-TICAM2 readthrough
  ENST ID: ENST00000333314
  CDS Start-End: 223-789
aggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattgattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctt

SEQ ID NO: 191475 - DNA, 755 bp, Homo sapiens
  Payload ID: 17820
  Gene Name: TMEM110-MUSTN1 readthrough
  ENST ID: ENST00000514466
  CDS Start-End: 1-446
gggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaa

SEQ ID NO: 191476 - DNA, 1405 bp, Homo sapiens
  Payload ID: 17820
  Gene Name: TMEM110-MUSTN1 readthrough
  ENST ID: ENST00000504329
  CDS Start-End: 113-1231
ggaggtaccggctcaggcttgggatcccggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaa

SEQ ID NO: 191477 - DNA, 2757 bp, Homo sapiens
  Payload ID: 17821
  Gene Name: TMEM189-UBE2V1 readthrough
  ENST ID: ENST00000341698
  CDS Start-End: 1-1113
atggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 191478 - DNA, 2557 bp, Homo sapiens
  Payload ID: 17822
  Gene Name: TMEM256-PLSCR3
  ENST ID: ENST00000573331
  CDS Start-End: 14-220
ctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgagcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggac

SEQ ID NO: 191479 - DNA, 1526 bp, Homo sapiens
  Payload ID: 17822
  Gene Name: TMEM256-PLSCR3
  ENST ID: ENST00000570600
  CDS Start-End: 14-139
ctgttctacagctatggccgggccagctgcagctttccgccgcttgggcgccttgtccggagctgcggccttaggcttcgcttcctacggggcgcacggcgcccaattcccagatgcctacgggaaggaggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgaaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaagg

SEQ ID NO: 191480 - DNA, 562 bp, Homo sapiens
  Payload ID: 17822
  Gene Name: TMEM256-PLSCR3
  ENST ID: ENST00000570569
  CDS Start-End: 14-220
ctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgatcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcag

SEQ ID NO: 191481 - DNA, 951 bp, Homo sapiens
  Payload ID: 17822
  Gene Name: TMEM256-PLSCR3
  ENST ID: ENST00000571125
  CDS Start-End: 1-87
tttgacaaggccaacaaacaccacttcttacacagcctggccctgttaggggtgccccattgcagaaagccactctgggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgaaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcag

SEQ ID NO: 191482 - DNA, 1689 bp, Homo sapiens
  Payload ID: 17823
  Gene Name: TMEM256-PLSCR3 readthrough (NMD candidate)
  Uniprot ID: Q9NRY6
  ENST ID: ENST00000324822
  CDS Start-End: 144-1031
cggggccggggtccgagctcgggcccgcctccgcctccgccagctcctgtgagctgccgagtgctaggcacccgggctcttctgggggctccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 191483 - DNA, 2067 bp, Homo sapiens
  Payload ID: 17823
  Gene Name: TMEM256-PLSCR3 readthrough (NMD candidate)
  Uniprot ID: Q9NRY6
  ENST ID: ENST00000535512
  CDS Start-End: 525-1412
gggccagcgcggcccgggccgccctcgcctcccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattg

SEQ ID NO: 191484 - DNA, 724 bp, Homo sapiens
  Payload ID: 17823
  Gene Name: TMEM256-PLSCR3 readthrough (NMD candidate)
  ENST ID: ENST00000571078
  CDS Start-End: 215-724
gagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgtgagttggctgcccctgcccccacctcctgcctgtcctttgctgtcatttgaagctttatgcatttcctggcctcttgctaggggaaagtcaggaataggtgttgtgggggttgaggttctagagctggcctgtgacagccaagctgggctggcccagccggatctcccattgacagtggcctcc

SEQ ID NO: 191485 - DNA, 581 bp, Homo sapiens
  Payload ID: 17823
  Gene Name: TMEM256-PLSCR3 readthrough (NMD candidate)
  ENST ID: ENST00000573213
  CDS Start-End: 227-581
cgcctccgcctccgccagctcctgtgagctgccgagtgctaggcacccgggctcttctgggggctccagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaaatggaagtacaggctccaccaggcaccaccattggccacgtgctacagacctggcatcccttcctcccc

SEQ ID NO: 191486 - DNA, 2032 bp, Homo sapiens
  Payload ID: 17823
  Gene Name: TMEM256-PLSCR3 readthrough (NMD candidate)
  Uniprot ID: Q9NRY6
  ENST ID: ENST00000574401
  CDS Start-End: 493-1380
cagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggaca

SEQ ID NO: 191487 - DNA, 1740 bp, Homo sapiens
  Payload ID: 17823
  Gene Name: TMEM256-PLSCR3 readthrough (NMD candidate)
  ENST ID: ENST00000573070
  CDS Start-End: 416-862
ggccagcgcggcccgggccgccctcgcctcccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaaatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaaa

SEQ ID NO: 191488 - DNA, 1965 bp, Homo sapiens
  Payload ID: 17823
  Gene Name: TMEM256-PLSCR3 readthrough (NMD candidate)
  Uniprot ID: Q9NRY6
  ENST ID: ENST00000576201
  CDS Start-End: 426-1313
tccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggaca

SEQ ID NO: 191489 - DNA, 1605 bp, Homo sapiens
  Payload ID: 17823
  Gene Name: TMEM256-PLSCR3 readthrough (NMD candidate)
  ENST ID: ENST00000576362
  CDS Start-End: 159-974
gaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatata

SEQ ID NO: 191490 - DNA, 583 bp, Homo sapiens
  Payload ID: 17823
  Gene Name: TMEM256-PLSCR3 readthrough (NMD candidate)
  ENST ID: ENST00000571802
  CDS Start-End: 477-583
ctgtgagctgccgagtgctaggcacccgggctcttctgggggctccagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtctt

SEQ ID NO: 191491 - DNA, 851 bp, Homo sapiens
  Payload ID: 17823
  Gene Name: TMEM256-PLSCR3 readthrough (NMD candidate)
  ENST ID: ENST00000575434
  CDS Start-End: 1-516
gctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggtttt

SEQ ID NO: 191492 - DNA, 2066 bp, Homo sapiens
  Payload ID: 17823
  Gene Name: TMEM256-PLSCR3 readthrough (NMD candidate)
  ENST ID: ENST00000619711
  CDS Start-End: 525-1196
gggccagcgcggcccgggccgccctcgcctcccacccagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattg

SEQ ID NO: 191493 - DNA, 680 bp, Homo sapiens
  Payload ID: 17824
  Gene Name: TMEM56-RWDD3 readthrough
  ENST ID: ENST00000604203
  CDS Start-End: 1-325
aatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcagtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaaga

SEQ ID NO: 191494 - DNA, 1491 bp, Homo sapiens
  Payload ID: 17824
  Gene Name: TMEM56-RWDD3 readthrough
  ENST ID: ENST00000604534
  CDS Start-End: 181-786
ccgggcgccccgcattcctctcgcgtttctcgggctgcacgattccggctgccctgtctgcctggcggtgcctctcgggtctgagcttaaagcgggtgggtgcaaacctttgggcatccagggagagctttcttgttagagcccacacacaatcgggcgcatcaagtgggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcaagacagatgggaccgtgttcagaattcacacaaaagctgaaggatttatggatgtggatatacctctggaattggtgttccatttgccagtcaattatccttcatgtctacctggtatctcgattaactctgaacagttgaccagggcccagtgtgtgactgtgaaagagaatttacttgagcaagcagagagccttttgtcggagcctatggttcatgagctggttctctggattcagcagaatctcaggcatatcctcagccaaccagaaactggcagtggcagtgaaaagtgtactttttcaacaagcacgaccatggatgatggattgtggataactcttttgcatttagatcacatgagagcaaagactaaatatgtcaaaattgtggagaagtgggcttcagatttaaggctgacaggaagactgatgttcatgggtaaaataatactgattttactacagggagacagaaacaacctcaaggtgccaaaaagttaaatgttgagtatgaatctggctattttctgctttaaatggtgtgtctttaagtgtgttttataacaatgggatagattaattattaagatgtttctgctttcattattacaatcttaatggatcttccttttctttttaaagaatgtctgactgctaattacaagtacaaacttgcaaagcttgaagaataagattgcattttaaaaatcatgtcacttaataaagtgacaggttatttaaaa

SEQ ID NO: 191495 - DNA, 1659 bp, Homo sapiens
  Payload ID: 17825
  Gene Name: TMEM9 domain family, member B
  Uniprot ID: Q9NQ34
  ENST ID: ENST00000309134
  CDS Start-End: 259-633
gacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctatgtcctctttggaatgtaacaataaaaataatttttgaaacatc

SEQ ID NO: 191496 - DNA, 1433 bp, Homo sapiens
  Payload ID: 17825
  Gene Name: TMEM9 domain family, member B
  Uniprot ID: Q9NQ34
  ENST ID: ENST00000525069
  CDS Start-End: 240-614
gctgcaggctggaccaaggggaggcacatggggagctccacagggaggccacgcccacgagggcagctcacagaattagaaagccgacggggtgctgtggtcaggaggcgcgtgggcggcagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaag

SEQ ID NO: 191497 - DNA, 949 bp, Homo sapiens
  Payload ID: 17825
  Gene Name: TMEM9 domain family, member B
  ENST ID: ENST00000528117
  CDS Start-End: 220-507
gcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggtaagttcccagcctgccctagctgctcatggccagtccctgtcatcattcgatgtgaagtgcaagtgaaaaatagtcatatatagatgttcacgtgctgaagcagatcctcaactagagaagctaaaaacagctctgatttcagtatatacctctttatgaagaaattgcttgatgaagccataaatgtgatgatttaaacgatgatctttggtgagcatgctatacagggccttgctttcagtaccaaaggcacaattttattgccattccctgtttacattgagaaaagtatcagagatggttttctctccaagctctcctgcctgaaacaccttctctgtcaatatcaccaaatattttagaaggcagagaggttttcatcaagggaagtgtgaagatcatgatgttcttttcttaatgaagtacaacttgataacctgctgatgttttatatttcctttttttctactgcttaaaaaaaaatctgtgggccaggtgtgggggcata

SEQ ID NO: 191498 - DNA, 2083 bp, Homo sapiens
  Payload ID: 17825
  Gene Name: TMEM9 domain family, member B
  Uniprot ID: Q9NQ34
  ENST ID: ENST00000534025
  CDS Start-End: 461-1057
gtgcgcgaacggctccggcccgcacgggtcgccagaggcgactgtgtgacactcggagtttgctggggtctccgtgggcgggaggactttccagcgcaatggcgactccctaagccccgcagcttctgcgcccgggaaagatatccaagagatgcaaagctctactgggcccaggctgccaccccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctatgtcctctttggaatgtaacaataaaaataatttttgaaacatc

SEQ ID NO: 191499 - DNA, 625 bp, Homo sapiens
  Payload ID: 17825
  Gene Name: TMEM9 domain family, member B
  ENST ID: ENST00000530136
  CDS Start-End: 466-625
ggaagctcctcccctaccaccggccttgcggaaactgggtctgccaacctgctccttggcccattcctgacagccatacgcctggcctcacagctccggcagacccccgccgccaccagccccgcccctcccgactgcccggcggcactctcgccctcagccccgacagcctggcaggcagcgccccacgatacttagtcacctgttcctccacctcttgaaacttgttttgttggtagttgttctgtctgtcaaccaggaattagaagcaaagtttcctgggaagagtatactaaactgatctcagagtcaggctacttcctgtgtgtacttcctttctagttgtagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagccca

SEQ ID NO: 191500 - DNA, 1958 bp, Homo sapiens
  Payload ID: 17826
  Gene Name: TMF1-regulated nuclear protein 1
  Uniprot ID: Q6NT89
  ENST ID: ENST00000522111
  CDS Start-End: 81-764
gccgtgtctagctgttcgggtgtgctgtggtcatcctccctgcgcacctacagccgcagaccgccggtggggggcgggggatgccgggctgccgcatcagcgcctgcggcccgggggcccaggaggggacggcagagcagaggtcgccgccgccgccctgggatcccatgccgtcctctcagcccccgcccccaactccgaccttgactcctaccccgaccccgggtcagtccccgccgctgccggacgcagctggggcttcagcaggcgcggccgaggaccaggagctgcagcgctggcgccagggcgctagcgggatcgcggggctcgccggccccggagggggctctggcgcggctgcgggggcggggggccgcgcgctggagctggccgaagcacggcggcggctgctggaggtggagggccgccggcgcctggtgtcggagctggagagccgcgtgctgcagctgcaccgcgttttcttggcggccgagctgcgcctggcgcaccgcgcggagagcctgagccgcctgagcggcggcgtggcgcaggccgagctctacctggcggctcacgggtcgcgcctcaagaagggcccgcgccgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgtaaggcaaatgcatggggttctgaggttcactttgcaagtgcccttgctgcctttcctctgtgtctattatggctctttaagttgacggttcctggagcagcttgtatttagtttcgtttggcagtctggccctgttgactttgatttgcagaccaattctcccttgacctgactcacagccgcctgctcttacccccctcctcaggaagtcttcctcattaaaggatgtgatgacggagctcagggatga

SEQ ID NO: 191501 - DNA, 575 bp, Homo sapiens
  Payload ID: 17826
  Gene Name: TMF1-regulated nuclear protein 1
  ENST ID: ENST00000531285
  CDS Start-End: 1-152
gcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgaggtgcggtcttagcggctgctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaa

SEQ ID NO: 191502 - DNA, 585 bp, Homo sapiens
  Payload ID: 17827
  Gene Name: TMX2-CTNND1 readthrough (NMD candidate)
  ENST ID: ENST00000528395
  CDS Start-End: 15-326
ttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccactctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccac

SEQ ID NO: 191503 - DNA, 6324 bp, Homo sapiens
  Payload ID: 17828
  Gene Name: TNF receptor-associated factor 1
  Uniprot ID: Q13077
  ENST ID: ENST00000373887
  CDS Start-End: 2447-3697
gcggcgggggctgtgctggcgccggcaggcgcgaggaatcacagagcggggcgcccagcctcatcatggggcggcccacggagacttcccgtgggagtggggtctggtgcaggggcgccccaaaggacgagtgggagatggggacacgcggcgcagagagactcctcgtggatggagccgatggaggcccagtgtagaagagaaaggggtcaaggagacggataaggagccaccagagacgcggggggaattccccgcagaggatgcgggaagccggggaaaggaagggattccggaaggaagggctgagagccgggtcaggtgctggcaggagggctggttggatagaaactggggcgggcccagggcatttggcgtccccgacatgcgtatacacttggagagatgattccctggagatccaagtgcctgtatagacaatcttttctagaagttctaccgttaggtgaggcgagagtagatgtagaaattggagacgagaataaagagtgttttaaaagcgtgcgtggttacaggactggctctgggttcaggggtccccactcactagctgtgagaccttgaacaagtcgcttagcctctctgtgcctcagttttctcatctgtaaggtggggatgatgatggcaatacctgcttcacagagtgaaaattagatgagatgatgtctgtaaaattacgtaagacggtacccaaaagtagtactatttttcccttttcttattagagcaggttgcgcacgttttgatgtccgtgggaatgagcaggtagagagggtggtattgaggccggaggggagagaagggacccacagatggggagagaagtcttgggtgcctgttttatcccaaaccaggggaaggagggaacaggtagggctggctgcaggaaagcttgcaggtatggggtacacagttaaaagggagtgtcttctgatagtcttgatgcaggcctggaggtcgtttgttatgggggtggaggtcctgatgtacattgtggcggtaagatgccgtgctgtctttgccaccagcctgtggcagccctggtgttacaccagggcaggtgggcagtttaatgtatctcaggccagatgacctgccctgcccacctgttgaggctccagtagatagacgtgaaagcacagtataagcataatgcaccactttaatccttttctctgaggagctggaaggcctgtagtcaccatctgagccaaatgtcattcaagtacttcacttgggttacacaccacactttgacccactatctcatttagtcatcacaacaaatgggtgaaataggtattattgtcccattttacagatgcagaatctgagtttcagggaagttaaggactttgtcccagggcccacagttagtaagcagtggacccaggatttcaactcagctctgtctgacctcaaaacccatgatctgaaaccactgtgaaagtttgcaaaacctctgtagcagccaagcaggatggaaagatgtgtagggattgtcttctccatttgatagatgagacaagagctgggtactctgatctccatcccaagcacacagagcttggggccccacagccctggtgtgaatcccactccactaccagaggctgtgtgcctttggaccaggcatcttgcttctctgaccctatatacagctgcagaagaattccttgcaggttgctgtaaggatttggagggaaactgttgcccagcacacagtacacattctgggagccatcgtttccccagtgcacttttcctgcaaatgtggatctacatcccacttggatgctgagaccagctgctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 191504 - DNA, 3715 bp, Homo sapiens
  Payload ID: 17828
  Gene Name: TNF receptor-associated factor 1
  Uniprot ID: Q13077
  ENST ID: ENST00000546084
  CDS Start-End: 204-1088
gatgattacggagctgtgtggactgtgccctgacaggagaaatagcagtgctgcccaggatcacagctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 191505 - DNA, 4303 bp, Homo sapiens
  Payload ID: 17828
  Gene Name: TNF receptor-associated factor 1
  Uniprot ID: Q13077
  ENST ID: ENST00000540010
  CDS Start-End: 426-1676
acactccaccggaagctccgggcctggccgccggtaggcggtggcggaggcggcgccgagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgca

SEQ ID NO: 191506 - DNA, 2264 bp, Homo sapiens
  Payload ID: 17829
  Gene Name: TNF receptor-associated factor 2
  Uniprot ID: Q12933
  ENST ID: ENST00000247668
  CDS Start-End: 53-1558
ttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 191507 - DNA, 680 bp, Homo sapiens
  Payload ID: 17829
  Gene Name: TNF receptor-associated factor 2
  ENST ID: ENST00000414589
  CDS Start-End: 318-680
tggcactcccaaagtgctgggattacaggctggtctcgaactcctggcctgaagtgatcctccaacctcagcctcccaagtagctgggattacaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctgggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatac

SEQ ID NO: 191508 - DNA, 709 bp, Homo sapiens
  Payload ID: 17829
  Gene Name: TNF receptor-associated factor 2
  ENST ID: ENST00000419057
  CDS Start-End: 195-709
agatgactgcagagtgagagtgaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcgg

SEQ ID NO: 191509 - DNA, 823 bp, Homo sapiens
  Payload ID: 17829
  Gene Name: TNF receptor-associated factor 2
  ENST ID: ENST00000429509
  CDS Start-End: 244-823
accggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggca

SEQ ID NO: 191510 - DNA, 7700 bp, Homo sapiens
  Payload ID: 17830
  Gene Name: TNF receptor-associated factor 3
  ENST ID: ENST00000347662
  CDS Start-End: 354-1985
gggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctc

SEQ ID NO: 191511 - DNA, 2239 bp, Homo sapiens
  Payload ID: 17830
  Gene Name: TNF receptor-associated factor 3
  ENST ID: ENST00000351691
  CDS Start-End: 137-1768
agaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttg

SEQ ID NO: 191512 - DNA, 2459 bp, Homo sapiens
  Payload ID: 17830
  Gene Name: TNF receptor-associated factor 3
  Uniprot ID: Q13114
  ENST ID: ENST00000392745
  CDS Start-End: 276-1982
cggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaa

SEQ ID NO: 191513 - DNA, 1786 bp, Homo sapiens
  Payload ID: 17830
  Gene Name: TNF receptor-associated factor 3
  Uniprot ID: Q13114
  ENST ID: ENST00000539721
  CDS Start-End: 92-1549
agcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgct

SEQ ID NO: 191514 - DNA, 738 bp, Homo sapiens
  Payload ID: 17830
  Gene Name: TNF receptor-associated factor 3
  ENST ID: ENST00000558700
  CDS Start-End: 1-624
ccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaagggatatgagaataaagagtctgagaattctgtcccgtctttgacagatggaaatgaatgaattgttactttcagagggacacaactaccacgcgatgctgcatatggcccgctccacattcgtgcaggtttccttgttgcagaatgaaagtgtagaaaaaaacaagagcataca

SEQ ID NO: 191515 - DNA, 870 bp, Homo sapiens
  Payload ID: 17830
  Gene Name: TNF receptor-associated factor 3
  ENST ID: ENST00000559734
  CDS Start-End: 1-870
agcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggg

SEQ ID NO: 191516 - DNA, 701 bp, Homo sapiens
  Payload ID: 17830
  Gene Name: TNF receptor-associated factor 3
  ENST ID: ENST00000560463
  CDS Start-End: 420-701
ccgcggcggaggacgcgcccggcgcccctgagccggccgagcggcgacggaccgcgagatggcgtctcgctctgtcacccaggctggagtgcagtggcgcgatccctgcttactgcagcttctgcctcccaggttcgagagattctcctgcctcagcctcccaagtagctgggactacagcagctgacatctgtgaagcctcagtgatcctataaattgaggaacctgagagaatcaagagaaagacaacaattcttgctgatatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagc

SEQ ID NO: 191517 - DNA, 7640 bp, Homo sapiens
  Payload ID: 17830
  Gene Name: TNF receptor-associated factor 3
  Uniprot ID: Q13114
  ENST ID: ENST00000560371
  CDS Start-End: 218-1924
cgagggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaatgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctca

SEQ ID NO: 191518 - DNA, 4279 bp, Homo sapiens
  Payload ID: 17831
  Gene Name: TNF receptor-associated factor 3 interacting protein 1
  Uniprot ID: Q8TDR0
  ENST ID: ENST00000373327
  CDS Start-End: 223-2298
gtccgttgctaaggccgcgcagccctagtgaccgaacgccctgcggcggccgcgcaggcgctgtggtgggctccggtgcactgtgggatggaaaccggagcggcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggaaggaaggaggataatatttcagctaaaagtttagactccatagtgtctggaataaataatgagccaaatcaggaaacgacaacatcagaaataggaacaaaagaagctaatattaactcaactagtatttcagatgataattcagctagtctgcggtgtgagaatattcagcccaaccccacagagaagcagaaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccataa

SEQ ID NO: 191519 - DNA, 4003 bp, Homo sapiens
  Payload ID: 17831
  Gene Name: TNF receptor-associated factor 3 interacting protein 1
  Uniprot ID: Q8TDR0
  ENST ID: ENST00000391993
  CDS Start-End: 223-2100
gtccgttgctaaggccgcgcagccctagtgaccgaacgccctgcggcggccgcgcaggcgctgtggtgggctccggtgcactgtgggatggaaaccggagcggcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaagggaacagtagtcctttattttggtttagtggaaagactttcagaggtcagtgccgaatgaaggatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagta

SEQ ID NO: 191520 - DNA, 1070 bp, Homo sapiens
  Payload ID: 17831
  Gene Name: TNF receptor-associated factor 3 interacting protein 1
  ENST ID: ENST00000409739
  CDS Start-End: 128-286
cggagcggcgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgggcgccggggaccgggcccggccaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaag

SEQ ID NO: 191521 - DNA, 2923 bp, Homo sapiens
  Payload ID: 17832
  Gene Name: TNF receptor-associated factor 4
  Uniprot ID: Q9BUZ4
  ENST ID: ENST00000262395
  CDS Start-End: 130-1542
cacagccgagccctggccgcgaccgccagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcaca

SEQ ID NO: 191522 - DNA, 683 bp, Homo sapiens
  Payload ID: 17832
  Gene Name: TNF receptor-associated factor 4
  ENST ID: ENST00000262396
  CDS Start-End: 29-616
gctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttgg

SEQ ID NO: 191523 - DNA, 672 bp, Homo sapiens
  Payload ID: 17832
  Gene Name: TNF receptor-associated factor 4
  ENST ID: ENST00000454852
  CDS Start-End: 1-339
gaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaaagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagcc

SEQ ID NO: 191524 - DNA, 631 bp, Homo sapiens
  Payload ID: 17832
  Gene Name: TNF receptor-associated factor 4
  ENST ID: ENST00000422344
  CDS Start-End: 84-631
cgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagttcccccatccctacccccagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgat

SEQ ID NO: 191525 - DNA, 1456 bp, Homo sapiens
  Payload ID: 17832
  Gene Name: TNF receptor-associated factor 4
  ENST ID: ENST00000444415
  CDS Start-End: 74-1387
gctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagca

SEQ ID NO: 191526 - DNA, 718 bp, Homo sapiens
  Payload ID: 17832
  Gene Name: TNF receptor-associated factor 4
  ENST ID: ENST00000478021
  CDS Start-End: 96-245
gccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagatcatgaaacgagattcaaagaaaggctgcgacttgcccagggtcacatagttacttaaaggcttaactaggatttaaacccggactgcttatgatcacacaatggaggaaggactgaatcctcccccgaagaaggacccctctaggcggctcccctctctcccgggggctggagtaaggcgggtggtccataagtcatgaagaagggggtcgcactcgtgttgttactgaactcccgctgccctctcaggacgcagcctgggccggctcctgccctcacatatgctccggcacaagctgcaggactgccccctccccctcggcagtgtacacatttactctcctacagacacagccccattgtctccgccactgctcttccccggccctctgggttccagatgaggccagctgagccccccgacccccccacagctgacccaccctgactgcctcgggaaaggagcgggggagggggcc

SEQ ID NO: 191527 - DNA, 544 bp, Homo sapiens
  Payload ID: 17832
  Gene Name: TNF receptor-associated factor 4
  ENST ID: ENST00000475329
  CDS Start-End: 1-277
tttctgcgatacctgcctgcaggagttcctcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgat

SEQ ID NO: 191528 - DNA, 825 bp, Homo sapiens
  Payload ID: 17832
  Gene Name: TNF receptor-associated factor 4
  ENST ID: ENST00000584944
  CDS Start-End: 682-825
gtggccgcaagctgacctttgccctggttcttggcagaggaccttcctggggactgggcagccttcgcacttaatctcagcccatccctgttccccctcccagtcagctttcagcgcagccaatgaaaactaacctagggggagggggtgactgtgcagcgtgttcctttcccagtccagctgccatcctgggggagggggtgccagctgccacctgttggccaagtcctgactgaggcagctgtctgtgcctcctctaggcccagaccccccttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctac

SEQ ID NO: 191529 - DNA, 789 bp, Homo sapiens
  Payload ID: 17832
  Gene Name: TNF receptor-associated factor 4
  ENST ID: ENST00000586813
  CDS Start-End: 78-239
cgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctg

SEQ ID NO: 191530 - DNA, 585 bp, Homo sapiens
  Payload ID: 17832
  Gene Name: TNF receptor-associated factor 4
  ENST ID: ENST00000473421
  CDS Start-End: 316-585
ttcccaggacaggggctggggtcttctgggatcctggggaagtagagcccctcaggcctctgcttgcccttttgtctcatctaggctggttgggaaccggtctgtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccag

SEQ ID NO: 191531 - DNA, 543 bp, Homo sapiens
  Payload ID: 17832
  Gene Name: TNF receptor-associated factor 4
  ENST ID: ENST00000618771
  CDS Start-End: 109-543
accgccagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctga

SEQ ID NO: 191532 - DNA, 3972 bp, Homo sapiens
  Payload ID: 17833
  Gene Name: TNF receptor-associated factor 5
  Uniprot ID: O00463
  ENST ID: ENST00000261464
  CDS Start-End: 55-1728
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 191533 - DNA, 3972 bp, Homo sapiens
  Payload ID: 17833
  Gene Name: TNF receptor-associated factor 5
  Uniprot ID: O00463
  ENST ID: ENST00000336184
  CDS Start-End: 61-1734
agacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttc

SEQ ID NO: 191534 - DNA, 1827 bp, Homo sapiens
  Payload ID: 17833
  Gene Name: TNF receptor-associated factor 5
  Uniprot ID: O00463
  ENST ID: ENST00000367004
  CDS Start-End: 61-1734
agtgcagggatgtgcagatgagtgggctgtggggtgtcctgctcacggtttcatggatgaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaa

SEQ ID NO: 191535 - DNA, 2558 bp, Homo sapiens
  Payload ID: 17834
  Gene Name: TNF receptor-associated factor 6, E3 ubiquitin protein ligase
  Uniprot ID: Q9Y4K3
  ENST ID: ENST00000348124
  CDS Start-End: 325-1893
gcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgatcatgaacttctgaagggacccagctttctttgtgtgctccaagtgatttgcacaaataataatatatatatttattgaaggagagaatcagagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgtt

SEQ ID NO: 191536 - DNA, 4627 bp, Homo sapiens
  Payload ID: 17834
  Gene Name: TNF receptor-associated factor 6, E3 ubiquitin protein ligase
  Uniprot ID: Q9Y4K3
  ENST ID: ENST00000526995
  CDS Start-End: 248-1816
agcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattttcctttgcgcttgcttatattttttacattttctacaataaatgtgtacttttatcggagaaaaaaattaaatgttgccacaaaacatttaatctccacgcccccagctcaaaaaaggaaatgatatttaaaagcttcctggtcagatttctattaaaagcactggctgtgcattagatacaaagaggagtcatttcctgccttggtgatactatttttttctactaactcaagagtctttattaaaaaaaaaagttgttttgcctaatttcagcttttagcaagcttcccatctgtaaaatgatttggaccagatatttctagagtcccctccagccataacattctgtctcaaattaagttccaaccagcagaacaatgacaatacttaggaaagtattttgccagtataaaatgtctttaacttactctttgctgacactgatactttcctctaatttagtgtctatcagctgggtcacatcttaagtaaaatgagcaattttaacccccaacatttggcattttgtcataaaccagccagttattttatgctggtcattcatcttgactacaaagtagaatagtcaagctgtcattccaaatagaaaactttttacttcaatcagaattaagccttaacctggaaagttggtttcttccttacattttcccaatctcctactctattcttaaacatgctagtttcactcagttgggtatacaagcctttgggctttatgttgtatgttactaaccaccttttaccatatttatcttttggcatcattctgggacattgctaaattaaaaaagaaattgtttccacttttttctggagatgttcaactaaaggttgttttgttttgttttttgttttgagacagtctcaccctgacgctcaggctggagtgcagtggtgcaacctcggctcactgcaac

SEQ ID NO: 191537 - DNA, 3700 bp, Homo sapiens
  Payload ID: 17835
  Gene Name: TNF receptor-associated factor 7, E3 ubiquitin protein ligase
  Uniprot ID: Q6Q0C0
  ENST ID: ENST00000326181
  CDS Start-End: 133-2145
cggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgatagctta

SEQ ID NO: 191538 - DNA, 737 bp, Homo sapiens
  Payload ID: 17835
  Gene Name: TNF receptor-associated factor 7, E3 ubiquitin protein ligase
  ENST ID: ENST00000567645
  CDS Start-End: 297-737
ggtgactggctgtgactcaggacccagaggagtagagggagccaggcaggggtccctccacctcggggaagagctggatgggctcttcgggagctcagaaaggctaagccttgagggacggtgacgcagagccgcctgcctgcccgggcctctgcatacctgggatcggggtgaaggacctttgcctcctagaggcctgcctgagccggggctggtggtggaaggctgctgcggcggccccacggtgccccacagcaggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtggg

SEQ ID NO: 191539 - DNA, 874 bp, Homo sapiens
  Payload ID: 17835
  Gene Name: TNF receptor-associated factor 7, E3 ubiquitin protein ligase
  ENST ID: ENST00000564067
  CDS Start-End: 69-233
gcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacaggggtctcctccgtcctccctctagaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccact

SEQ ID NO: 191540 - DNA, 666 bp, Homo sapiens
  Payload ID: 17835
  Gene Name: TNF receptor-associated factor 7, E3 ubiquitin protein ligase
  ENST ID: ENST00000567653
  CDS Start-End: 94-354
gggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcacctgcaggccaggatgaggcatatttggctccatcttaagggaggtggaaaccacagaaagttcagtcaggaggatagcacaataaaatacatgctttgaaa

SEQ ID NO: 191541 - DNA, 799 bp, Homo sapiens
  Payload ID: 17835
  Gene Name: TNF receptor-associated factor 7, E3 ubiquitin protein ligase
  ENST ID: ENST00000565383
  CDS Start-End: 200-364
ggcagccgtccgggcccggagaggcggggaactacacgtcccggcgggcgcagcggcctggcgcttccggctcgcgcgtctagtccctttcccggccggcggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacaggggtctcctccgtcctccctctagaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatggtaggtccctacccccaggagcccgtgtgagcctcagcctccccccatcctccctcctgggggaaccaggtcccaggaggagttgacagtgagctggtgaggcacaggagaagaagagcacctgtggataccctgaggcctcggcagacatggcaagtctgtgagaaaggaggctcctgtggctggactgtgggtggcagggggcagccagtgagggcagctgggtcagagggcctggcacctgcaggccaggatgaggcatatttggctccatcttaagggaggtggaaaccacagaaagttcagtcaggaggatagcacaataaaatacatgctttgaaagcttc

SEQ ID NO: 191542 - DNA, 2296 bp, Homo sapiens
  Payload ID: 17836
  Gene Name: TNF receptor-associated protein 1
  Uniprot ID: Q12931
  ENST ID: ENST00000246957
  CDS Start-End: 90-2204
gaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccga

SEQ ID NO: 191543 - DNA, 2052 bp, Homo sapiens
  Payload ID: 17836
  Gene Name: TNF receptor-associated protein 1
  Uniprot ID: Q12931
  ENST ID: ENST00000538171
  CDS Start-End: 6-1961
acgacatggcgcgcgagctgcgggcgctgctgctgtggggccgccgcctgcggcctttgctgcgggcgccggcgctggcggccgtgccgggaggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccg

SEQ ID NO: 191544 - DNA, 2309 bp, Homo sapiens
  Payload ID: 17836
  Gene Name: TNF receptor-associated protein 1
  ENST ID: ENST00000575671
  CDS Start-End: 731-2218
gtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccg

SEQ ID NO: 191545 - DNA, 587 bp, Homo sapiens
  Payload ID: 17836
  Gene Name: TNF receptor-associated protein 1
  ENST ID: ENST00000571538
  CDS Start-End: 481-587
atttggtcctgtggatttctctttcagcaacagcccgacttagagatgtccacgctagcttctgctagacacccttgatgggacgaattaccatattgtttctcgtgtcttcctaattctcattctttctgcatatttgtcttttcaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgc

SEQ ID NO: 191546 - DNA, 645 bp, Homo sapiens
  Payload ID: 17836
  Gene Name: TNF receptor-associated protein 1
  ENST ID: ENST00000576335
  CDS Start-End: 1-645
tccctgtactcagaaaaagaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaa

SEQ ID NO: 191547 - DNA, 785 bp, Homo sapiens
  Payload ID: 17836
  Gene Name: TNF receptor-associated protein 1
  ENST ID: ENST00000575707
  CDS Start-End: 1-179
ccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcaga

SEQ ID NO: 191548 - DNA, 535 bp, Homo sapiens
  Payload ID: 17836
  Gene Name: TNF receptor-associated protein 1
  ENST ID: ENST00000574175
  CDS Start-End: 1-326
tggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatg

SEQ ID NO: 191549 - DNA, 480 bp, Homo sapiens
  Payload ID: 17836
  Gene Name: TNF receptor-associated protein 1
  ENST ID: ENST00000571011
  CDS Start-End: 17-277
gctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggccgagtgctgtagtgcaatcatggctcactgaagcctcgacctccctggctcaagtgatcctcccacctcagccccctgagtcactgggaccacaagttccacttccaaacatgagttccaggccgagacaaagaagcttttggacattgttgcccggtccctgtactcagaaaaagaggtgtttatacgggagctgatctccaatgccagcgatg

SEQ ID NO: 191550 - DNA, 521 bp, Homo sapiens
  Payload ID: 17836
  Gene Name: TNF receptor-associated protein 1
  ENST ID: ENST00000570403
  CDS Start-End: 5-118
cgacatggcgcgcgagctgcgggcgctgctgctgtggggccgccgcctgcggcctttgctgcgggcgccggcgctggcggccgtgccgggaggctcccgtagggccattgaaatgtgaagaatccttcgtctatgaagtgtccccacatcaaaactgcattagtcgtgctgtcgcctaggctcgagtgcagagatgcaatttcagctcactgaacctctgcctcccaggttcaagcgattctagtgcgttggtctcgcgagtagctaagattacaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtg

SEQ ID NO: 191551 - DNA, 781 bp, Homo sapiens
  Payload ID: 17836
  Gene Name: TNF receptor-associated protein 1
  ENST ID: ENST00000571804
  CDS Start-End: 9-122
agtacgacatggcgcgcgagctgcgggcgctgctgctgtggggccgccgcctgcggcctttgctgcgggcgccggcgctggcggccgtgccgggaggctcccgtagggccattgaaatgtgaagaatccttcgtctatgaagtgtccccacatcaaaactgcattgaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatgg

SEQ ID NO: 191552 - DNA, 2785 bp, Homo sapiens
  Payload ID: 17837
  Gene Name: TNFAIP3 interacting protein 1
  Uniprot ID: Q15025
  ENST ID: ENST00000315050
  CDS Start-End: 111-2021
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaaga

SEQ ID NO: 191553 - DNA, 2935 bp, Homo sapiens
  Payload ID: 17837
  Gene Name: TNFAIP3 interacting protein 1
  ENST ID: ENST00000389378
  CDS Start-End: 242-2101
agtctccggggactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgcaccagttttgtcgcagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatc

SEQ ID NO: 191554 - DNA, 1815 bp, Homo sapiens
  Payload ID: 17837
  Gene Name: TNFAIP3 interacting protein 1
  ENST ID: ENST00000519339
  CDS Start-End: 24-1502
gggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagggcacacacagaggctgccccagacaccttccagagaggaaggttaagtgaggggttcagaaactgcatccttctgaactaaacagcaccgtggtggcagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccag

SEQ ID NO: 191555 - DNA, 2238 bp, Homo sapiens
  Payload ID: 17837
  Gene Name: TNFAIP3 interacting protein 1
  Uniprot ID: Q15025
  ENST ID: ENST00000522226
  CDS Start-End: 107-2017
atgcaccaaggaaggagtgggccccttcttcactatggatggagaagcctcagagagtaagtggcaacagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgact

SEQ ID NO: 191556 - DNA, 2711 bp, Homo sapiens
  Payload ID: 17837
  Gene Name: TNFAIP3 interacting protein 1
  Uniprot ID: Q15025
  ENST ID: ENST00000523338
  CDS Start-End: 111-2018
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaaga

SEQ ID NO: 191557 - DNA, 575 bp, Homo sapiens
  Payload ID: 17837
  Gene Name: TNFAIP3 interacting protein 1
  ENST ID: ENST00000521001
  CDS Start-End: 177-575
atacatactgttctgtgactccccgaaagagggattctctctacattctgaaatttgttgtccctatcctggtattgagaagtcaccttcctgatacaaaaagaaggaacaagttgggagaccacagtgactcaacgacaccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcag

SEQ ID NO: 191558 - DNA, 877 bp, Homo sapiens
  Payload ID: 17837
  Gene Name: TNFAIP3 interacting protein 1
  ENST ID: ENST00000522100
  CDS Start-End: 106-877
agaagcacagtgagccgaggagccttcatagggacagccgcccctggtgcacacaccctcgtattctcctgcccttccccaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgca

SEQ ID NO: 191559 - DNA, 2680 bp, Homo sapiens
  Payload ID: 17837
  Gene Name: TNFAIP3 interacting protein 1
  Uniprot ID: Q15025
  ENST ID: ENST00000520931
  CDS Start-End: 161-1912
cgggtgccctgcccccgtccaggagccctaggagtgctacggggggccggagccttgcccgggccgctgccccgtccctggattcggggctggacgcagcaagcggggcgctgtgtccccaagctccccgtcctcgggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 191560 - DNA, 1716 bp, Homo sapiens
  Payload ID: 17837
  Gene Name: TNFAIP3 interacting protein 1
  Uniprot ID: Q15025
  ENST ID: ENST00000524280
  CDS Start-End: 1-1671
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagagtctccaaaaaatgaccgtgaggggcctcagtgagaccagattgtgtcatttggctccaccttcatcttgcagagccagctgatctcagattgccaagaaactagaagccacttgcacggtgtggcca

SEQ ID NO: 191561 - DNA, 658 bp, Homo sapiens
  Payload ID: 17837
  Gene Name: TNFAIP3 interacting protein 1
  ENST ID: ENST00000520695
  CDS Start-End: 228-658
acttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggaaaccgaggtacttggagcttgaggtcacacagctccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgc

SEQ ID NO: 191562 - DNA, 562 bp, Homo sapiens
  Payload ID: 17837
  Gene Name: TNFAIP3 interacting protein 1
  ENST ID: ENST00000517504
  CDS Start-End: 1-441
gccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaaga

SEQ ID NO: 191563 - DNA, 2274 bp, Homo sapiens
  Payload ID: 17837
  Gene Name: TNFAIP3 interacting protein 1
  Uniprot ID: Q15025
  ENST ID: ENST00000521591
  CDS Start-End: 232-2142
gactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccag

SEQ ID NO: 191564 - DNA, 2200 bp, Homo sapiens
  Payload ID: 17837
  Gene Name: TNFAIP3 interacting protein 1
  Uniprot ID: Q15025
  ENST ID: ENST00000518977
  CDS Start-End: 232-2139
gactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagccagctgatctcagattgccaagaaactagaagccacttgcacggtgtggccagagcctcagctggatgagaggctgagatgggtggccag

SEQ ID NO: 191565 - DNA, 1743 bp, Homo sapiens
  Payload ID: 17837
  Gene Name: TNFAIP3 interacting protein 1
  Uniprot ID: Q15025
  ENST ID: ENST00000523200
  CDS Start-End: 1-1719
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctcc

SEQ ID NO: 191566 - DNA, 2726 bp, Homo sapiens
  Payload ID: 17837
  Gene Name: TNFAIP3 interacting protein 1
  Uniprot ID: Q15025
  ENST ID: ENST00000610535
  CDS Start-End: 242-1960
agtctccggggactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatc

SEQ ID NO: 191567 - DNA, 2629 bp, Homo sapiens
  Payload ID: 17837
  Gene Name: TNFAIP3 interacting protein 1
  Uniprot ID: Q15025
  ENST ID: ENST00000610874
  CDS Start-End: 242-1912
agtctccggggactttcccaggggtggggcggcccggccaggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtacaccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatc

SEQ ID NO: 191568 - DNA, 1974 bp, Homo sapiens
  Payload ID: 17838
  Gene Name: TNFAIP3 interacting protein 2
  Uniprot ID: Q8NFZ5
  ENST ID: ENST00000315423
  CDS Start-End: 88-1377
ggaaagttccgggaagggcggcagccggcggggcccgggcgcggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggctgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgactgc

SEQ ID NO: 191569 - DNA, 1653 bp, Homo sapiens
  Payload ID: 17838
  Gene Name: TNFAIP3 interacting protein 2
  ENST ID: ENST00000503235
  CDS Start-End: 54-1094
ccgggcgcggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggctgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattca

SEQ ID NO: 191570 - DNA, 2006 bp, Homo sapiens
  Payload ID: 17838
  Gene Name: TNFAIP3 interacting protein 2
  Uniprot ID: Q8NFZ5
  ENST ID: ENST00000510267
  CDS Start-End: 429-1397
agttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggtacgagggcgggtaccagaggagctgcgggagcgagagtgcgtgtggcggccgccgggtcctgggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggctgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgactgctctgagaatttg

SEQ ID NO: 191571 - DNA, 2416 bp, Homo sapiens
  Payload ID: 17839
  Gene Name: TNFAIP3 interacting protein 3
  Uniprot ID: Q96KP6
  ENST ID: ENST00000057513
  CDS Start-End: 216-1193
ttgcagtgcttataactttattctgtgtaattcctatccacagtcacttctgttcatttttaatgaaaacctattgctgttattttctattatgagttaacggtgatgtgtgttttttaaattttgtatacttgctctcaccctaaaatataccttaagagacttttcccctgtttttctttctgctttccaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatggtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcattaaattaaataagtggttcaatctgaataagatggttaattggaagctattccttagacagatcatttctttaagatgatgagaaattgtgcgcctgcatcacaagacttgattatgaaagataaagtcttgggctgggtgcagtggctcatgcctataatcccagcactttgggaggctgaggcaggtggattgctttgaggccaggagttctagaccagcctggccagcatggtgaaaccccatctctactataaatacaaaaattagccaggctcgtggcacacacctataaacccagctactcaggaggcttgaggcgggaggatcacttgagcccagggaggcagaggttgctgtaagttgagatcgccactgcactccagcctgggaaatagagtgagcaagactcagtgccccctacccacccactccacaccaccaaaaaaaaaaaaaaaaaaaaaaggaagacaaagtcctgatgggatgatgatggctatatggctatgctgtgtccatatatacttacagaaatatttcagacatatggatttatagttaaatctgtgtttttccttcccttggatttgattaattttaatgaaaaacttaattctgacttctcaagccaattaaaatgaaaatggaatttattgaaa

SEQ ID NO: 191572 - DNA, 712 bp, Homo sapiens
  Payload ID: 17839
  Gene Name: TNFAIP3 interacting protein 3
  ENST ID: ENST00000515036
  CDS Start-End: 1-261
tgtaactgcggcttggttttccacctgcaagatccatgggtaccaacaggccctggagctgtgcagaagcaacgggagcacccaccagactatcagtggtatgctcttgaccagcttccgccagatgtacaacacaaggcaaatgaatctgctatactttctactgcttgtttctatggtcttgtgaggccacccagaagcgggctgtataaactgagctataatcaaaatcccacttctattctcatcaagtatacataatcaaaagttagaaatgtctgctacatgtttaaagtctcatatgacacacacctgggactctaacttgttaatttccaaagatttgaatctatctaaaaatgctgaagatgagctatgtagtctaatttcaggccattcttgaaatttgatctcgtttgaagtcagagctgagatcacagaaatctagtttttaatacaaggagtctgttatggagtgtaaatagggagtcagggacaccacatgtagttttgcaggttgtgaactttacaagtctgaggggctcatcatggtactctatgtgaatggagcctgctgaagtacaatacgcaatctggacagctgtacacagcagcaatgggagtgacaaaggccatagattacaacagcatcatagaaaagaaatatgaaatgtgagaattccataataaaatatccaggtatttatcaaaa

SEQ ID NO: 191573 - DNA, 1575 bp, Homo sapiens
  Payload ID: 17839
  Gene Name: TNFAIP3 interacting protein 3
  Uniprot ID: Q96KP6
  ENST ID: ENST00000509841
  CDS Start-End: 80-1210
aagagtcttaaagacaggtctccgtattagaccttgtaatacgcttacctagatctgagaaggactttcaggatagaacatgattccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccagtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgca

SEQ ID NO: 191574 - DNA, 1778 bp, Homo sapiens
  Payload ID: 17839
  Gene Name: TNFAIP3 interacting protein 3
  Uniprot ID: Q96KP6
  ENST ID: ENST00000507879
  CDS Start-End: 61-1170
gagaataaaaacatggcttttgatgaaaaatgcatttaacagattccatgtggatggctcatgaacaaaaatgagaaacacgacgataaactggtaatgttcaccaatcaatctgaagattctgaaagatgtgaaagcatggagctggacaaaaaaatccaggatctgattgagagaaatgcgtctcctcatccaaaacggttcaccccagaggccatgccaactcacagaaatctatgttctctgaagactccaggaaaaacagcttccatggcacattttgtacagggcacatctagaatgattgccgcagaaagttctacggagcataaagagtgtgctgaaccatcaacaagaaagaacttgatgaattctcttgaacaaaagataaggtgtttggaaaaacaaagaaaagagctcctggaagttaaccagcaatgggatcagcaatttagaagtatgaaagagttatatgaaagaaaggtagcagagctgaagacgaaactggacgccgcggaaagattcctcagcacgcgggagaaggatccgcatcagaggcagagaaaggacgacaggcagagagaggacgacaggcagcgcgacctgacccgggaccggctgcagcgggaggagaaggaaaaggaacgcctaaatgaagaattacatgaattgaaagaagagaataaacttttaaagggaaaaaatactcttgcgaacaaggaaaaggaacattacgaatgtgaaataaaacgcctcaataaggctcttcaggatgccttgaatatcaagtgttcattttccgaggactgtttgaggaagtctcgagtggaattctgccatgaggagatgagaacagaaatggaagttctgaagcagcaggtgcaaatatacgaagaagacttcaaaaaggaacgatcggatcgagagagacttaatcaagagaaagaggagctacagcaaattaatgaaacttcccaatcccagttgaacaggctgaattcccagataaaagcttgtcagatggagaaagaaaaactagaaaagcaattaaaacagatgtattgcccaccctgtaactgcggcttggttttccacctgcaagatccatgggtaccaacaggccctggagctgtgcagaagcaacgggagcacccagtttatcctcagtaaagaaagtccatccgtagaagtacacactaacagagagagacaacaggcaacgagggagcgtggctgaggaccctcttctttgtttatactgaggcttgtttctgccacaaaggcacatcatctaccctgttatttgtgcctggtcatgttttcctttggtatgaatacaggaaaaggcttctgacagctaagatcctgatcaaattggaggagccagttattatacaaccaaatacaacttccagtttccttgaaatgagacttggcagatggatgatgcacgactccctgaaaatctcttcagcatattgctgttggatgcacaaaaatgattctatgatttaggcaactcagtgtttgctgcagggatattgtatgttgatttaaagtgcatatgtgtgtgtgtgtgtgtgtgtgtgtgtgtgtgtgtgtgtttcctggggtaaaaatttctgcagttgtaaacgtttaacattgctcccattcttcttccacagggccttagttctttagctatttgactacatattgttgacctcagtgatcctaaacgtagaattgaagaggtgtatatacctcattaaattaaataagtggttcaatctgaa

SEQ ID NO: 191575 - DNA, 1877 bp, Homo sapiens
  Payload ID: 17840
  Gene Name: TNFRSF1A-associated via death domain
  Uniprot ID: Q15628
  ENST ID: ENST00000345057
  CDS Start-End: 470-1408
agatacgttcggccgggcttgtacctgggacccatgggcaccccgttttgagtgcccactggtagcagcgatcttgaagccggatccccaggggtaccagaaaattctggtctccagggggcgcccccttgatttaccgaagtctggcagctgtagctcttacgagccccccgcctcgtaagaatcgcaaacccccaaagtcgggtcttcctgccgtctaaccttgggcgctggtgtcttacctgctcggcggaccagatgggctttgcccggggcaggggactggcagcagaggacagcggacgggaagcagccaccgggagcccgcggggcgggacgcgcgggcggacggggcggctcgggctagggcaccgccccagcgcctccgcgcacacccggaagcggcggagtagagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 191576 - DNA, 1833 bp, Homo sapiens
  Payload ID: 17840
  Gene Name: TNFRSF1A-associated via death domain
  Uniprot ID: Q15628
  ENST ID: ENST00000486556
  CDS Start-End: 625-1383
ctttctactaattgtggatgtctctctcctcttttcctctcttactgcagcactccttgctcaagacccctccccagtacctacccttccaggcccccctttcccatctcagggcagaggccacaggaggctgaagcgggttgggggatctgttcgtggcctcagagcggcgagagcccctcttcttcccgagcagtgggagtcgcgcttggtggaggccgaagacctgagacctctcgccctcctctgccctgctggccgcctacccagacggcttgtttgcccagggcacacgcccccttttctgtgcttcgaagtccctctcttttgccaaccctcatttggggcgtgagagcgggggttaggtggcacccactctgtcttagggtgctccctgtgacagatcctggtcttctttctgggttattgctgtttgtatcccaattttgcttcccagctgggtactctggggtaactgcaccctaggtcaggggatgggacgcggggcttcaccacgggcttcgcccctcctccggccgtttggagaacggccgagcttggggaccgcccggcgcctgaccgcccgcctccgcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggat

SEQ ID NO: 191577 - DNA, 1816 bp, Homo sapiens
  Payload ID: 17841
  Gene Name: TNFSF12-TNFSF13 readthrough
  ENST ID: ENST00000293826
  CDS Start-End: 56-1048
atccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgata

SEQ ID NO: 191578 - DNA, 3001 bp, Homo sapiens
  Payload ID: 17842
  Gene Name: TNNI3 interacting kinase
  Uniprot ID: Q59H18
  ENST ID: ENST00000326637
  CDS Start-End: 52-2559
aatcttataacttgaagaactgccctggagaaaggaagaaacttataataaatgggaaattataaatctagaccaacccaaacttgtactgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatag

SEQ ID NO: 191579 - DNA, 696 bp, Homo sapiens
  Payload ID: 17842
  Gene Name: TNNI3 interacting kinase
  ENST ID: ENST00000526236
  CDS Start-End: 1-452
cacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagatgctgtacaggatggctcagctgctaccacccagactgataaactgggtcatctggtctcctggccccaggagactgactcagcatcaagaggacaactttgacaccctatgatatcatctccaacccaaccaatcagcagtccccactttcagacccctacccaccaagttttccttaaaacccccatcctcaagtttttgagaagactgatttgagtaataataacactcttctctcctgtacagctggctgtgcgtgaattaaacttttctctattgcaa

SEQ ID NO: 191580 - DNA, 510 bp, Homo sapiens
  Payload ID: 17842
  Gene Name: TNNI3 interacting kinase
  ENST ID: ENST00000525480
  CDS Start-End: 1-341
gatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaa

SEQ ID NO: 191581 - DNA, 566 bp, Homo sapiens
  Payload ID: 17842
  Gene Name: TNNI3 interacting kinase
  ENST ID: ENST00000534020
  CDS Start-End: 1-566
gtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacaggtctgccattacctctaggatctggatcacccatagtatttgcatctggaggggagctcattactttaacagggaagaatgcaatttcaggtgtatgcttacttctgccatcctaaaagaatcaagatttctacagtctctggatgaagacaacatgacaaaacaacctgggaacctccgttggatggctcctgaggtgttcacgcagtgcactcggtacac

SEQ ID NO: 191582 - DNA, 2338 bp, Homo sapiens
  Payload ID: 17843
  Gene Name: tocopherol (alpha) transfer protein
  Uniprot ID: P49638
  ENST ID: ENST00000260116
  CDS Start-End: 33-869
gggtagctgcggccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaactattataagtggagagcagaatgtccagaaataagtgcagatctacaccctagaagtattattggcctcctaaaggctggctaccatggagtcctgagatccagggatcccactggcagcaaagttcttatttacagaatcgcacactgggaccccaaagtttttacagcttatgacgtatttcgagtaagtctaatcacatccgagcttattgtacaggaggtagaaactcagcggaatggaatcaaggctatctttgatctggaaggttggcagttttctcatgcttttcaaatcactccatccgtagccaagaagattgctgctgtacttacggattcatttccattgaaagttcgtggcatccatttgataaatgaaccagtaattttccatgctgtcttttccatgatcaaaccattcctgactgaaaaaattaaggaacggattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttactttttaaatgcttttttctctacttttgaagtaattaaatgtcagtacattttaagagcataaaaatcggcgattttgtacttgaagagaacatgaaagttattgctaaagtagctgctcatgtgcatctttgtatgtttctagaaagttatattttaaacaagttctctgattaaattggtttagaaaaaaatttagaaatattccgcttaaaaatactagcacaagtcagctaatgataaaaaaattaacacttgttttaagtggatgtcagattaaattataattcattataattaaaatctgaatagagttttatggttattcctgtggaccagcaagacatttcatctcagggaaattttattttagtatattaacacgatagaaactttttttttttttttcagacagagtcttgctctgtcgcccaggctagagtgcagtagtgagatctcagctcactgcaacctctgctaggattacatgtgcacaccaccactcctggctaagttttgtattttatatagagatggggttttgccacgttggccaagctggtctcaaactcctgaactcaagtaatttgcctgcttcggcctcccagagtcctgggattacagtcgtgagccatcgcgcctggccgtgatagaaactttcagctgaggagtctatatgccatactactctatgtggcatctttaggtctctgtgaaatcatgttgatgtaattgattaacaaaaataatttagaaaatacgtcaggcacagttgatggcttctcaatatctgctttgcatttttaaacaaatcaagaatgtaattttaacttttgcttatggtcattcttatgactacacggaaagggatggaatcatacttacttgtcttatacatggactgtttttagttaacaataacgtaactacacaaaggaaaggaaatgtttacattttaaaaaattactgtcaattacatctggtatttttcagattatgcataaaataatatgagtttgactattgtatcagaatattttaatcaaatcctgcaatttatattaacttaaaaaaacatctggtaaagactgggtgtggcagctcacacctgtaatcccagcactttgggaggccgaggctggatggatgattgcttgagcgcaggagttctagaccagcctgggcaatacagggagaccctgtctctatttcaaaaataaataaataggccccggtgtgtgatgttccccttcctgtgtccatgtgttctcaaaaaaaattaaaaaataaaaataaaaa

SEQ ID NO: 191583 - DNA, 6212 bp, Homo sapiens
  Payload ID: 17844
  Gene Name: tocopherol (alpha) transfer protein-like
  Uniprot ID: Q9BTX7
  ENST ID: ENST00000262605
  CDS Start-End: 122-1150
gcgagaggccgggcaggccgggcagggagtgcgggtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 191584 - DNA, 6234 bp, Homo sapiens
  Payload ID: 17844
  Gene Name: tocopherol (alpha) transfer protein-like
  Uniprot ID: Q9BTX7
  ENST ID: ENST00000372904
  CDS Start-End: 144-1172
gagaggccgggcaggccgggcagggagtgcgggtcggttctgcgtgcgctgccggacgaggctcccgccgccgattgacccgcgctccgcccgtagtcgggccgttctgttccaagagataaccattgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 191585 - DNA, 1139 bp, Homo sapiens
  Payload ID: 17844
  Gene Name: tocopherol (alpha) transfer protein-like
  ENST ID: ENST00000372906
  CDS Start-End: 121-585
cgggcagggagtgcgggtcggttctgcgtgcgctgccggacgaggctcccgccgccgattgacccgcgctccgcccgtagtcgggccgggcttctctgttggcagggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagttcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtgg

SEQ ID NO: 191586 - DNA, 926 bp, Homo sapiens
  Payload ID: 17844
  Gene Name: tocopherol (alpha) transfer protein-like
  ENST ID: ENST00000456317
  CDS Start-End: 88-926
gtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggcca

SEQ ID NO: 191587 - DNA, 2283 bp, Homo sapiens
  Payload ID: 17845
  Gene Name: toll interacting protein
  ENST ID: ENST00000263646
  CDS Start-End: 157-897
gcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatt

SEQ ID NO: 191588 - DNA, 3617 bp, Homo sapiens
  Payload ID: 17845
  Gene Name: toll interacting protein
  Uniprot ID: Q9H0E2
  ENST ID: ENST00000317204
  CDS Start-End: 125-949
gctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 191589 - DNA, 3429 bp, Homo sapiens
  Payload ID: 17845
  Gene Name: toll interacting protein
  ENST ID: ENST00000525159
  CDS Start-End: 122-763
gactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggtt

SEQ ID NO: 191590 - DNA, 549 bp, Homo sapiens
  Payload ID: 17845
  Gene Name: toll interacting protein
  ENST ID: ENST00000527938
  CDS Start-End: 126-368
agctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcc

SEQ ID NO: 191591 - DNA, 3666 bp, Homo sapiens
  Payload ID: 17845
  Gene Name: toll interacting protein
  Uniprot ID: Q9H0E2
  ENST ID: ENST00000527886
  CDS Start-End: 382-999
acactggcgtgggagctgccttgccaagagcagttgcatgaaatgccacttatttgctcaagggttgtttattgaacatgccagtgccaggagactggcgtggagcatgaggccgaggctggctggagtgggttttggggagtgtcaggaggctggtgtggagcgtgaggccgaggctggctggagtgccaggggctgcagggtcaggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttt

SEQ ID NO: 191592 - DNA, 684 bp, Homo sapiens
  Payload ID: 17845
  Gene Name: toll interacting protein
  ENST ID: ENST00000530541
  CDS Start-End: 126-684
agctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagcca

SEQ ID NO: 191593 - DNA, 1297 bp, Homo sapiens
  Payload ID: 17845
  Gene Name: toll interacting protein
  ENST ID: ENST00000530506
  CDS Start-End: 86-625
tccgtcgcaggctccggcgggggcgcaggaggtcgcccggcgcgtcactgtcgggtcggcgagccacgggggccgccgcagcaccatggcgaccaccgtcagcactcagcgcgggccggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagacattgtaaattttggaacagccccgcacttcatagaaaagttcccaaggagatgcaggaacatctgccagagcctgtgaggactcgtccacctgacgccccaccggagcccccagcccccatgcccaggcatgcgtttccaataagcaggggcgtccctggcacagtacggccatctagatgaagctgacactgacgcgttggggctgtaccctgcttggagcccgtctgagtccgcagcatccaggccggggtcactggccctccatggccttgcctcccttggcctggaggggtccccatcttgctcctaggggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgg

SEQ ID NO: 191594 - DNA, 1264 bp, Homo sapiens
  Payload ID: 17846
  Gene Name: toll-interleukin 1 receptor (TIR) domain containing adaptor protein
  Uniprot ID: P58753
  ENST ID: ENST00000392678
  CDS Start-End: 430-1137
cgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggccaagttactcacccg

SEQ ID NO: 191595 - DNA, 2195 bp, Homo sapiens
  Payload ID: 17846
  Gene Name: toll-interleukin 1 receptor (TIR) domain containing adaptor protein
  Uniprot ID: P58753
  ENST ID: ENST00000392679
  CDS Start-End: 284-949
gcgctgctcttccccgcggagcccgcgcagtccgcgcagccctcatcgcaactgggcccgcgcgcaggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctact

SEQ ID NO: 191596 - DNA, 2068 bp, Homo sapiens
  Payload ID: 17846
  Gene Name: toll-interleukin 1 receptor (TIR) domain containing adaptor protein
  Uniprot ID: P58753
  ENST ID: ENST00000392680
  CDS Start-End: 406-1071
ccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaa

SEQ ID NO: 191597 - DNA, 2245 bp, Homo sapiens
  Payload ID: 17846
  Gene Name: toll-interleukin 1 receptor (TIR) domain containing adaptor protein
  Uniprot ID: P58753
  ENST ID: ENST00000479770
  CDS Start-End: 40-705
aatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcatcttgctctgtcgcccaggctggagtgcagtggcgcaaccttggctcactgcaacctttgcctcccaggttcaagcgattctcctgcctcagcctcccaagtagctgggactacaggtgcgtgtcaccacacccagataattttttgtatttttagtagcgatagggtttcaccgtgttagccaggagggtctcgatctcctgacctcatgatccacccacctcgggctcccaaagtgctggaattacaggcatgagccactgcacccagcctttttttaattattatttgaagaatttaagattggaattaattgctccttgaatgtttggtagactcatctgtaataccatttgagcctagaatattctggtttttttgagacggagtcttgccctattgcccaggccggagtgcagtgggattacacgcgtgagccaccatgcctggccagaatattctttattgtaaaatttaaagctgtaatttcaatgtcttgaagagttatagatctaattagattttccatttctcctggagtcaatttggtacaaacagtcaataaagactacaagaccagtttaagta

SEQ ID NO: 191598 - DNA, 889 bp, Homo sapiens
  Payload ID: 17846
  Gene Name: toll-interleukin 1 receptor (TIR) domain containing adaptor protein
  ENST ID: ENST00000488598
  CDS Start-End: 467-616
agagcggggcctgcgcgctgctcttccccgcggagcccgcgcagtccgcgcagccctcatcgcaactgggcccgcgcgcagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggccttacataggaagtccttctaaagagctgcctgccagctgcccttccccagatcccgaatatcctcctggccaggtggagcagagaacagttcctcagctggtcatgctgagctcataccctgatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctgactggttcaggcagaccctgctgaagaagcccaagaagaggcccggctccctgacatacctgacactgcattatctcagttaactttcagcaactaagacaggtccacaagtccacagtcaaagccgtgtccctgactccagagtactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacag

SEQ ID NO: 191599 - DNA, 2849 bp, Homo sapiens
  Payload ID: 17847
  Gene Name: toll-like receptor 1
  Uniprot ID: Q15399
  ENST ID: ENST00000308979
  CDS Start-End: 275-2635
acagactgccaaatggaacagacaagcaggttgtcttgtgttaaagaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataactttgatttaaacagttctgacacat

SEQ ID NO: 191600 - DNA, 2779 bp, Homo sapiens
  Payload ID: 17847
  Gene Name: toll-like receptor 1
  Uniprot ID: Q15399
  ENST ID: ENST00000502213
  CDS Start-End: 231-2591
agaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataa

SEQ ID NO: 191601 - DNA, 648 bp, Homo sapiens
  Payload ID: 17847
  Gene Name: toll-like receptor 1
  ENST ID: ENST00000505940
  CDS Start-End: 166-648
gttttcaacaccaaatgtggttaacagtgaaataaattcaaggaagtgcttgaatttcttacagactgccaaatggaacagacaagcaggttgtcttgaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcat

SEQ ID NO: 191602 - DNA, 578 bp, Homo sapiens
  Payload ID: 17847
  Gene Name: toll-like receptor 1
  ENST ID: ENST00000515861
  CDS Start-End: 308-578
aactatgtaatgtaattccagtggaattcggtaggtggcataaaacagcctttttgttttgttttgttttcaacaccaaatgtggttaacagtgaaataaattcaaggaagtgcttgaatttcttacagactgccaaatggaacagacaagcaggttgtcttgtgttaaagaaaatgagatataagtcagttactcccggaggcaatgctgctgttcagctcttctgtttttgtggccagaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaat

SEQ ID NO: 191603 - DNA, 555 bp, Homo sapiens
  Payload ID: 17847
  Gene Name: toll-like receptor 1
  ENST ID: ENST00000506146
  CDS Start-End: 410-555
aattgtatttccgttcatttacaagttattttctcttcttctgaaaaagagatcttgtggatggatgaaaaggcaagaggaaaaacaaagcagccgaaacacacccagacgcacacttctgccaagcatagccaccacgactgccaaatggaacagacaagcaggttgtcttgtgttaaagaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaat

SEQ ID NO: 191604 - DNA, 605 bp, Homo sapiens
  Payload ID: 17847
  Gene Name: toll-like receptor 1
  ENST ID: ENST00000508364
  CDS Start-End: 535-605
atagctttatttgcccatttattgtgttgttattttgttgttgtcattactggaaaaggcaagagtagagctatcagaatgtcttccttgaacatgctgtcaacaaaccccaggatttttataaaccctatgtgaaaaacacgctaagaatctcttttcttcttagcatatttttcacttagggtttacaaaaatatgttttgaagaaagcttgaaaagatcagtggaaaaaaattcagcaccaaattttctctgaaaatcaacttgtcaaaaaagacgtgattaacatccatcctgtaaccagcacatgaatgatcttccctctttacgagtgtgcttcagcaaaactttaatctcgacccctccctctttccacttttaatagtggatggatgaaaaggcaagaggaaaaacaaagcagccgaaacacacccagacgcacacttctgccaagcatagccaccacgaatctgtatctgtatcaagatgatctgaagaacagcttctacctttaggaatgtctagtgttccaaaatgactagcatcttccattttgccattatcttcatgttaatacttcagatcagaatacaattatctgaaga

SEQ ID NO: 191605 - DNA, 3958 bp, Homo sapiens
  Payload ID: 17848
  Gene Name: toll-like receptor 10
  Uniprot ID: Q9BXR5
  ENST ID: ENST00000308973
  CDS Start-End: 607-3042
cgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 191606 - DNA, 3484 bp, Homo sapiens
  Payload ID: 17848
  Gene Name: toll-like receptor 10
  Uniprot ID: Q9BXR5
  ENST ID: ENST00000361424
  CDS Start-End: 133-2568
agccaattctgaccgtgtcaacgaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 191607 - DNA, 3462 bp, Homo sapiens
  Payload ID: 17848
  Gene Name: toll-like receptor 10
  Uniprot ID: Q9BXR5
  ENST ID: ENST00000506111
  CDS Start-End: 485-2920
gcttttgccaccaacctgaagacatatagaggcagaaggacaggaataattctatttgtttcctgttttgaaacttccatctgtaaggtaagtgttgaaagtcagatattggctccagggactttctatatccacaaatacaaaaattgaggggtaactccttgatatcaagtcaaaggctcacaatgtctggtaataaaacaaattactttcaattttcttgaaatcttcaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaa

SEQ ID NO: 191608 - DNA, 2616 bp, Homo sapiens
  Payload ID: 17848
  Gene Name: toll-like receptor 10
  Uniprot ID: Q9BXR5
  ENST ID: ENST00000508334
  CDS Start-End: 151-2586
tgcttttgccaccaacctgaagacatatagaggcagaaggacaggaataattctatttgtttcctgttttgaaacttccatctgtaagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggacc

SEQ ID NO: 191609 - DNA, 676 bp, Homo sapiens
  Payload ID: 17848
  Gene Name: toll-like receptor 10
  ENST ID: ENST00000502321
  CDS Start-End: 394-676
gccaattctgaccgtgtcaacgaatcatccacgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactga

SEQ ID NO: 191610 - DNA, 3801 bp, Homo sapiens
  Payload ID: 17848
  Gene Name: toll-like receptor 10
  Uniprot ID: Q9BXR5
  ENST ID: ENST00000613579
  CDS Start-End: 450-2885
agccaattctgaccgtgtcaacgaatcatccacgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 191611 - DNA, 3673 bp, Homo sapiens
  Payload ID: 17848
  Gene Name: toll-like receptor 10
  Uniprot ID: Q9BXR5
  ENST ID: ENST00000622002
  CDS Start-End: 322-2757
agccaattctgaccgtgtcaacgaatcatccacgcacctgcagctctgctgagagagtgcaagccgtggggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 191612 - DNA, 4200 bp, Homo sapiens
  Payload ID: 17849
  Gene Name: toll-like receptor 2
  Uniprot ID: O60603
  ENST ID: ENST00000260010
  CDS Start-End: 1409-3763
aagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttatttaaaaaaaaaaagagggaatgcgaagcagtggttttggtgcgaacacaaaaattctggcttcaacagcatttaaattcccaaaccaagcatgtttgtgttttaattctttgtggccataaattgtacagctcaggcctttatagtctctcagattctgtgaatgtggggaattagttttactcataaaaagttttgttcttggggataaattttttaaaaaaatttttgtatagttagcacactgagaaaatacagacaaaggcatacagatgcaagaaatgaggtagctgaatagaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggagaaaagaaatgcttaaatgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgtgtgtgtgtgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgt

SEQ ID NO: 191613 - DNA, 6015 bp, Homo sapiens
  Payload ID: 17850
  Gene Name: toll-like receptor 3
  Uniprot ID: O15455
  ENST ID: ENST00000296795
  CDS Start-End: 105-2819
tttcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaacattgtctactgattaatatacaatcagccactgagcctatgacagcttaaggagtttgaaaacattcctcattttaagaaaagttagaggtatatgagggtttgtgatgatctttttgtattttggatgcacttagaatgaaagataattgtttcaatgggtataatgctatttcctttgtaaaagagtaaaatatatacccatatttttaacaagtttaattacagtattttttcaatggaaaaactttgtattttagtaagtacttgtctcagtgttgactttgttaaatgttaaatattttttaatatacatacccaagggcagaaaacatttgcaattcatttttattagttaatgagatgattatttgaatgaatattgacttgtattttcctgagattatgagtttctgctgtgggagggtggaaacaattctcttactaaaagtattgtaggcaggcttgctttctgaaggctaatcactatttggctttgtggaaacagaactttcctcccatggtcacagactcaggagatggcgttggcaaaatcacttggtcccactgggattctttgactcctgatcttgaaaattatgataataaatgcatcttagatattcctatgtaattagtgatgatgatcgctgtataatatattcaaaggaatgtattattttaccataaaataatgtgctacgcataaggtagtccttatctagaaagactatttttatttttgtttttttgtttgtttgttttttatttgtttgtttttgagacagagtctggctctgtcgcccaggctggagttcagtggtccaacctcggcccaccgcaacctccacctctgagttcaagctattctcctgcctcagccacccgagtagctgggattacaggcacatgccaccatgcctggctaatttttgtatttttagtagagatggggtttcaccatgttggccaggctggtcttgaactcctgacctcaagtgatcctctcgccttggcctcccaaagtgctaggattacaggtgtgagccaccgcgccccgcctttttattttgttttacaatacaacaaaaaatttttagttttacaataaaagagaatctgattattggaaatagacctgaatagctttttgaaatatttatagttctagtatttaaagagaaacctgaaattataaagctgagttaatttctatacctgaaatgttcatttgtctgctgaattcagggagcatttgagatgtcacattttggaactttgatttaaatagttcagtattcccaaggctgagttccatgaccctggaatgagaaatatccactgtacctctggttctgaagagtctatagtcggccaacactgtgaatgtgtggaggactaattgtcactttcatgttatttgccaccctgacagctgagacactgcttttcagcattttagttaagatttgctttttaactgtgcaataatcattttattttggcattataaaataaaaatcacaacttctgcttttcttatatgctttgtgtgttatcacacaaatattctcaaatattcataagatattttaaataaatcattgtgaattagtcaatatatcaagttgcttaatatgtcatatatcaatgctatttaatatataatatctatatttaatatattgatatgttactggtggagagtgtccaggttcttggtgctttgaacaaggaattggacaaaatgcacaaagaatgaggcgacaaaagcagaggtttattgaaaacgaaagcacaccccgcagggtgggagcggcccgagcaagcagctcaaaagccgggttacaggattttctggggtttaaatactctctagaggtttccattggttacttggtttatgccctatgtaaatgaagaggctaaagtgaaattacaaagttatttacttgttgtgcaccctacgcaaatgaatagctgtcacagctgaggtagagttacagtgatttacttggtggtagaatgttgggatttttccatttgattgagttctaggaagcctttagtttccctgcctgcagaccccattctcctgcctcagatatatcaatgacatattcaatacatcattaagttgcttaatatttaagaggttaagatgcacaggtaatgacctctaaatgaatgccaataaaaatagtaaaaggtgtaaactctgactcctatctgacctaggtaggaagtaacatccagaacttctgcaggctgtcctgtgtaattgttctccggaggaacccttgtccctggggtttgagagaaggggatcgaggaaaaggatgtttgtctgagctcttgtttgatttgcccaagtgacttgacttgtttgaatcctctcagggtgccatcatgtaatctgtccactccaacttcttcctgtttttcacattgcaaaacaaaacccaactgaatcgacactgagtttaaaataaatcttggtatttaggttgtacctaaaaatgataacttttagactgtaatcagaggtagatgctatcaatttgttagtgaggaggggaggagttttcgatgccacttagtttacaatgtctaattgttcaaatatacatctaggttgtaaaggagactcaacggtaagttatagtgaccattgaaaaatgtaaaggggcttcaaatcaagaacttagaaggaatttcttgcaatctattgagacacaaagcagatgagtggttgtctgggcctaggaacaggaatggggagtggctgcaaataggtggaagagaccttttttgggtgatgaaagtgctctataattgggttatggtaataattgtacaactatgtaaatttactgaaagtcattgagttggacacttaaaacaggtgaattttatgatatgtaaattatatattcacaaagccattaaaaattgtattttttgagca

SEQ ID NO: 191614 - DNA, 1156 bp, Homo sapiens
  Payload ID: 17850
  Gene Name: toll-like receptor 3
  ENST ID: ENST00000513189
  CDS Start-End: 102-1156
cactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtgtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaa

SEQ ID NO: 191615 - DNA, 2310 bp, Homo sapiens
  Payload ID: 17850
  Gene Name: toll-like receptor 3
  Uniprot ID: O15455
  ENST ID: ENST00000504367
  CDS Start-End: 411-2294
aagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattc

SEQ ID NO: 191616 - DNA, 4844 bp, Homo sapiens
  Payload ID: 17851
  Gene Name: toll-like receptor 4
  Uniprot ID: O00206
  ENST ID: ENST00000355622
  CDS Start-End: 102-2621
aagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaa

SEQ ID NO: 191617 - DNA, 3908 bp, Homo sapiens
  Payload ID: 17851
  Gene Name: toll-like receptor 4
  Uniprot ID: O00206
  ENST ID: ENST00000394487
  CDS Start-End: 382-2781
tttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaacta

SEQ ID NO: 191618 - DNA, 3368 bp, Homo sapiens
  Payload ID: 17852
  Gene Name: toll-like receptor 5
  Uniprot ID: O60602
  ENST ID: ENST00000366881
  CDS Start-End: 642-3218
ggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaa

SEQ ID NO: 191619 - DNA, 459 bp, Homo sapiens
  Payload ID: 17852
  Gene Name: toll-like receptor 5
  ENST ID: ENST00000407096
  CDS Start-End: 396-459
ggagccaaccgtggcgcaggcggcgcggggaggcgtcccagagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattc

SEQ ID NO: 191620 - DNA, 4088 bp, Homo sapiens
  Payload ID: 17852
  Gene Name: toll-like receptor 5
  Uniprot ID: O60602
  ENST ID: ENST00000540964
  CDS Start-End: 463-3039
aagtaagtttgtattttaccatagattgatgttcatgttcctgacactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcccttagaggtttccagtctccattgattttctttcagatccaataataccgttctgtcctgctgtgttgattatggaatgtatcctaatcatgggaagggcaccttgggagaagttgcagatggctgacgtgctttctctagcattcagctaaaaaatgggatggtccatgattctgcgttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtgactgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttccttcgttgccctaatgaccacaagagaacacatacactgaaggcctcctggggggcagttgcaatttcactgaagttgtatttttttatcttaaatgaaatctatgtgtattttc

SEQ ID NO: 191621 - DNA, 2938 bp, Homo sapiens
  Payload ID: 17853
  Gene Name: toll-like receptor 6
  Uniprot ID: Q9Y2C9
  ENST ID: ENST00000381950
  CDS Start-End: 67-2457
agaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttca

SEQ ID NO: 191622 - DNA, 5880 bp, Homo sapiens
  Payload ID: 17853
  Gene Name: toll-like receptor 6
  Uniprot ID: Q9Y2C9
  ENST ID: ENST00000436693
  CDS Start-End: 122-2512
aattgtatttccgttcatttacaagttattttctcttcttctgaaaaagagatcttgaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaatagcttatttaattttttatcctgctacacaaatatgtaattaaccaatgaggactcatgacttgatagtgtatgtatgtaaagggatatatggacttaatcataagctgttgaggtgaaagacgtggatccacctgctttccaagaaaactcggccaaatttatttgcagctggatattgaatgggacttttctggttgtcttagaattctggctaaaggctcaaagctgacgaaagacagtaactgcaccaacatgatactagacacagccagtctggacttatcaaaagagcagaaagagaccaatgactcccagtccgtattatccatctctagaagactagagtcaaaagcgtgattaaagagtcattaagcggaggttctaggccatagggagattgctttgaatttcttgcagacaagtgtgagggactcagcatggtagaaggtagcctggcatcccactccaagactgaaagcttgcagagtaacaggagcacacaggttcagtgcagcagatgtggtgtggcttgagaattcttggaagagcttgatgagtgtttgctggagtccgagggtgggcactgggaacacagagactggtaaatagtgtttggcaaatacaagtgcttgatgaatatttgttgaatgaatagatgagttcttcccccctggggaattcaggaggtgaaaggttggcttgagcacccaaaatggcaggatgagagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcagtaagaggacacggggttaggcagaagaggggtttggggtggaggttgctgcaagaggtcagccagataatgtggccctgcatcatggaactgtgcaatgtggggtacactcaaggccctccaataactcacagatgtgccctatgaaaaagccagcatttggactctgccatagcagctggcaggatcatgctggcctgtctgccttattcaatagttaactacaggaagatctgctcctctttgtgtaataccctcttcccttgcaatggcatagggacatctagaatatagagaagacagagacaatggaggaagagtaaagaaactgactatatgccttcgtcatttcactgcaaggaaggccaagcagatttttgaatgaggtgtgagattgctgttaaattggactggcctggacattttaatcccttaaatagaggtgcaatgactaaagtgagatttgtcactaaaatttatggtatctgcccaagattcaggagtgatgatgggaggagatccaacagaactttgttgtaaggcaatggttagagaaaaatgaagccctcgctttctggacttagttcattcaataaaccagtttcggccaggcacgttggctcacatctataatcccagtactgtgggaggctgaggcaggtggatcacttgaggtcaggagttcgagaccagcctggccaacatggtgaaaccctgtctgtactaaaaatacaaaaattagccgggtgtggtggtgtgcacctgtagtcccagctactcgggaggctgaggcaggaaaatcacttgaacctgggagacagaggctgtagtgagctgagacagcgctactgtactccccgctgggcaacagagtgagactccatctcaaaaaagttaaaagaaaaaaaatctggtttcataatagctgtaacgaaataagccttaatgatattttattagcatcatcttctgtctgcattagcccttccttgctcttcaggagaacaacatttgttttcctccctaggctctatcccaaacggcacattcttccacaacccctgttgaacagattttttaaactgttgcctaatctaaaaacaataaaaacaacaaacaaccacagtaacaacaacgacaaaaaaaactgccacagattctaaataatcagatctttttaaatggtatcaatgtttcccacaaaatattgttgacattgaaaatatagaattttagcattaattttgttaaacctacatcccctcggcagaggggcctccctgcatcccagtggaaagtaggttcctcacagtcctctccgtcacattcttcccatttcttttcttcacagaacacatcactgtctaaaattatcttgtttgcttagttgcttactcatcttcttcttctctcctctgaagtctaagctccaggaaaaagggagacttctccacctgttccctgcctctccccagtgccgaggggacactgtgcaccccattgtagatgcgcagtaaaaactcgtgggatgagcaaatgactctgaaacggtcccatgcgggaaatgtccatgaagtcctggattttatctaaaaagcccaggcaggggggggcgggggcggcggggctacagttccacgctgagctgcctcctggccgctcgtccccgccgcagtgcctgggcggcccgggcgcccgaccttggccgtggacaccttcgcggtgggtgctgctcctccccatctgccactggaagatgctggggcgacccggctccaggtttagcaggacactgagaaaagggaatggctgcctttcggaggctgggtgagcccttctctgtgcctcacctgcccgccccacagcggccctgcacctcgtcccacggggcccattgccccggtaggatgcgcgcttttgttttgagggtcaggcatcttccctgccgtcgtttctgggaggttgaaaaattgatccagaaagacct

SEQ ID NO: 191623 - DNA, 548 bp, Homo sapiens
  Payload ID: 17853
  Gene Name: toll-like receptor 6
  ENST ID: ENST00000514655
  CDS Start-End: 275-548
aattgtatttccgttcatttacaagttattttctcttcttctgaaaaagagatcttgtggccaagtggatttttcaaatgtatgtgtgtctctgtgggtgttctgatgggcagttgggagaagttatatggatcagtgaagagcttttaaccatacgccattcagtaataaaagttccccaactcagagttttcactcttccaaagaaagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttg

SEQ ID NO: 191624 - DNA, 572 bp, Homo sapiens
  Payload ID: 17853
  Gene Name: toll-like receptor 6
  ENST ID: ENST00000508254
  CDS Start-End: 122-572
aattgtatttccgttcatttacaagttattttctcttcttctgaaaaagagatcttgaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttct

SEQ ID NO: 191625 - DNA, 1443 bp, Homo sapiens
  Payload ID: 17853
  Gene Name: toll-like receptor 6
  Uniprot ID: Q9Y2C9
  ENST ID: ENST00000610323
  CDS Start-End: 1-1443
atgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaa

SEQ ID NO: 191626 - DNA, 5011 bp, Homo sapiens
  Payload ID: 17854
  Gene Name: toll-like receptor 7
  Uniprot ID: Q9NYK1
  ENST ID: ENST00000380659
  CDS Start-End: 140-3289
gaagactccagatataggatcactccatgccatcaagaaagttgatgctattgggcccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttccttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagc

SEQ ID NO: 191627 - DNA, 4216 bp, Homo sapiens
  Payload ID: 17855
  Gene Name: toll-like receptor 8
  Uniprot ID: Q9NR97
  ENST ID: ENST00000218032
  CDS Start-End: 88-3213
agtttctcttctcggccacctcctgcatagagggtaccattctgcgctgctgcaagttacggaatgaaaaattagaacaacagaaacatggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaagatgcaaaggaatgacatttctgtattagttatctattgctatgtaacaaattatcccaaaacttagtggtttaaaacaacacatttgctggcccacagtttttgagggtcaggagtccaggcccagcataactgggtcctctgctcagggtgtctcagaggctgcaatgtaggtgttcaccagagacataggcatcactggggtcacactcatgtggttgttttctggattcaattcctcctgggctattggccaaaggctatactcatgtaagccatgcgagcctctcccacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaa

SEQ ID NO: 191628 - DNA, 3367 bp, Homo sapiens
  Payload ID: 17855
  Gene Name: toll-like receptor 8
  Uniprot ID: Q9NR97
  ENST ID: ENST00000311912
  CDS Start-End: 152-3331
ctcctgcatagagggtaccattctgcgctgctgcaagttacggaatgaaaaattagaacaacagaaacatggttctcttgacacttcagtgttagggaacatcagcaagacccatcccaggagaccttgaaggaagcctttgaaagggagaatgaaggagtcatctttgcaaaatagctcctgcagcctgggaaaggagactaaaaaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatactaactgacgttaagtcatgatttcgcgccataataaaga

SEQ ID NO: 191629 - DNA, 3870 bp, Homo sapiens
  Payload ID: 17856
  Gene Name: toll-like receptor 9
  Uniprot ID: Q9NR96
  ENST ID: ENST00000360658
  CDS Start-End: 635-3733
ggaggtcttgtttccggaagatgttgcaaggctgtggtgaaggcaggtgcagcctagcctcctgctcaagctacaccctggccctccacgcatgaggccctgcagaactctggagatggtgcctacaagggcagaaaaggacaagtcggcagccgctgtcctgagggcaccagctgtggtgcaggagccaagacctgagggtggaagtgtcctcttagaatggggagtgcccagcaaggtgtacccgctactggtgctatccagaattcccatctctccctgctctctgcctgagctctgggccttagctcctccctgggcttggtagaggacaggtgtgaggccctcatgggatgtaggctgtctgagaggggagtggaaagaggaaggggtgaaggagctgtctgccatttgactatgcaaatggcctttgactcatgggaccctgtcctcctcactgggggcagggtggagtggagggggagctactaggctggtataaaaatcttacttcctctattctctgagccgctgctgcccctgtgggaagggacctcgagtgtgaagcatccttccctgtagctgctgtccagtctgcccgccagaccctctggagaagcccctgccccccagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggcta

SEQ ID NO: 191630 - DNA, 2676 bp, Homo sapiens
  Payload ID: 17857
  Gene Name: toll-like receptor adaptor molecule 1
  Uniprot ID: Q8IUC6
  ENST ID: ENST00000248244
  CDS Start-End: 231-2369
cagcgcgctacggtccgcgggcaactccgcagaagccccagcccccaggaccccaggacccagtggcgcagccggcagccccggatccctgatctgcttgggcagctcctgcagaacctggaacagtgaatgggtaggggacactgggcgtgcagaaggcggggggcagtgtggaacatgccttcaccacctccagcttctgctgccggaggctgcacccacctgtgcccatggcctgcacaggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgct

SEQ ID NO: 191631 - DNA, 1650 bp, Homo sapiens
  Payload ID: 17857
  Gene Name: toll-like receptor adaptor molecule 1
  ENST ID: ENST00000621756
  CDS Start-End: 6-1646
tcaggatgaggcccgaaccggtgtgggtggacttgctggggatccagggagcatccggacgctccagtccatctggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccaccctccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgc

SEQ ID NO: 191632 - DNA, 3049 bp, Homo sapiens
  Payload ID: 17858
  Gene Name: toll-like receptor adaptor molecule 2
  Uniprot ID: Q86XR7
  ENST ID: ENST00000427199
  CDS Start-End: 443-1150
acattaacccctgactcacagctggaccgccccggcccgcagcgccacgtcccgggtggggcctgccacggcaaagcagcagtccggcctcgagcggcccctcgggggcggcggggtgggcgccaacagcagtcaggcctgacaagcggcgacctccaagggtgaggcctctgcgggcccccgactcacgcgcgtccgggctctgcaagcgcggtggggagcaggctgctgtggtcgcggggactgggttgcggcgcgccgcgtacgggacggccccaaactctcgacgcccggggcaagacgcccaccccctgggcgctctcgctgggccagaaaggaagacagaaaagccgcgggctgactgtggtggcgctcgcctgcagattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattcttt

SEQ ID NO: 191633 - DNA, 6708 bp, Homo sapiens
  Payload ID: 17859
  Gene Name: tolloid-like 1
  Uniprot ID: O43897
  ENST ID: ENST00000061240
  CDS Start-End: 648-3689
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaagttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatcatgttctcgttttgtagttcagaaagtgaggctcaaagaatttatgtaaccttcccagagtcacagtgtaaagttagatgttgaaacccagtttatcttatacaaatgagcctctgcttgttctacaaaggtagtagaatcaatctcgacctatataaatagtagattttttatggtgaaactttcccacataaagtaaattttaggggtgaattagagtaaaacttacaggataagcattttgctctttttaagaacagcatgaaatttagaataccaatgatagctatctttaagaatcagaattagtactagaaatttaaaaaaccctatagtttggagttagtatgagccttttgtgaaaataaatatattaaattattttgcctgatgtggtaggggaaatgtattgctctatattaagaaatattctggatattctgattgacatcttattaggccatagtgagctatgctctgcacaactgagaaattaggtatttagaaggcatatagagatgttgtcataactaggtcttcaacgtgaaaattaatttttattgtatcatgtcaagtatcagtttaccacatattatttttatattaattcaacatttgccttaagtgtgttgttaaatgaaagtacagacagcttcattgttgtattgttaataattgttacttactgctccaggcattttattaaattaattttttaaattattttccaccctacatcagtatattggttgtgctttatatttgccaaagtcctaactgactatacatagaaaaaaaaaaaaacactgttctcacttgattttattaaattatttttaaaagtc

SEQ ID NO: 191634 - DNA, 686 bp, Homo sapiens
  Payload ID: 17859
  Gene Name: tolloid-like 1
  ENST ID: ENST00000504560
  CDS Start-End: 220-393
agccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgactgaccactgctctaagcagtgttggggcaatgcctgggctgcccgagcccttgaagttcaagaagaagcacctggacttctcatgaggggaggtcagagtcaatctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttg

SEQ ID NO: 191635 - DNA, 4787 bp, Homo sapiens
  Payload ID: 17859
  Gene Name: tolloid-like 1
  ENST ID: ENST00000509505
  CDS Start-End: 558-950
ccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggtatatcaatgtttaaagttgcagacgcttgacttgatgcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacc

SEQ ID NO: 191636 - DNA, 1829 bp, Homo sapiens
  Payload ID: 17859
  Gene Name: tolloid-like 1
  Uniprot ID: O43897
  ENST ID: ENST00000513213
  CDS Start-End: 166-1344
tcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaaggttgtattttcactctgttgattgtgtcttctgatgaacacaaattataaagtttgatgtcataccacttgtctacttttagttttattgcctgtgcttttggtgtcatagccaagaaatcatggccatatgtaatgacatgaagtttttaccctgtgttttcttctatgagttctatagttttacagtcttatatgtaggtttttaatcaatattgtgttaatagaaaccattcttgtacatgtggatatccagtttcttcaacaccatttgttaaagatttactaaatgtttttattcagcattcctgctcatgtttctgacttctattatggcttattttggtcctgcctatagcttacattatagattattttttaaattagcgtttttgtttttttctgtttgaaaatgtggattttttacatgaatttataaaactatagtttcactggatatagttggctgcacatttaactttgttttaaataaaagcttgcaaaaat

SEQ ID NO: 191637 - DNA, 558 bp, Homo sapiens
  Payload ID: 17859
  Gene Name: tolloid-like 1
  ENST ID: ENST00000506144
  CDS Start-End: 227-558
actggccgcggctcgtgtccgggcttcgggagctcctggttccttgctctattgggctgtggctgaggtgatccgcgctcagtgtggacgcacaactgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtgg

SEQ ID NO: 191638 - DNA, 4818 bp, Homo sapiens
  Payload ID: 17859
  Gene Name: tolloid-like 1
  ENST ID: ENST00000507499
  CDS Start-End: 558-3668
ccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccgctgtattttggggcgatattgccttagatgatgaagacttaaatatctttcaaatagataggacaattgaccttacgcagaacccctttggaaaccttggacataccacaggtggacttggagaccatgctatgtcaaagaagcgaggggccctctaccaacttatagacaggataagaagaattggctttggcttggagcaaaacaacacagttaagggaaaagtacctctacaattctcagggcaaaatgagaaaaatcgagttcccagagccgctacatcaagaacggaaagaatatggcctggaggcgttattccttatgttataggaggaaacttcactggcagccagagagccatgttcaagcaggccatgaggcactgggaaaagcacacatgtgtgactttcatagaaagaagtgatgaagagagttacattgtattcacctataggccttgtggatgctgctcctatgtaggtcggcgaggaaatggacctcaggcaatctctatcggcaagaactgtgataaatttgggattgttgttcatgaattgggtcatgtgataggcttttggcatgaacacacaagaccagatcgagataaccacgtaactatcataagagaaaacatccagccaggtcaagagtacaattttctgaagatggagcctggagaagtaaactcacttggagaaagatatgatttcgacagtatcatgcactatgccaggaacaccttctcaagggggatgtttctggataccattctcccctcccgtgatgataatggcatacgtcctgcaattggtcagcgaacccgtctaagcaaaggagatatcgcacaggcaagaaagctgtatagatgtccagcatgtggagaaactctacaagaatccaatggcaacctttcctctccaggatttcccaatggctacccttcttacacacactgcatctggagagtttctgtgaccccaggggagaagattgttttaaattttacaacgatggatctatacaagagtagtttgtgctggtatgactatattgaagtaagagacgggtactggagaaaatcacctctccttggtagattctgtggggacaaattgcctgaagttcttacttctacagacagcagaatgtggattgagtttcgtagcagcagtaattgggtaggaaaaggctttgcagctgtctatgaagcgatctgtggaggtgagatacgtaaaaatgaaggacagattcagtctcccaattatcctgatgactatcgcccgatgaaagaatgtgtgtggaaaataacagtgtctgagagctaccacgtcgggctgacctttcagtcctttgagcaggagcaccaggagaatccagggattgccagtaaagccagagaatctctcatcctcatctggaagcctattgaaagacatgacaattgtgcttatgactacctggaagttagagatggaaccagtgaaaatagccctttgatagggcgtttctgtggttatgacaaacctgaagacataagatctacctccaatactttgtggatgaagtttgtttctgacggaactgtgaacaaagcagggtttgctgctaacttttttaaagaggaagatgagtgtgccaaacctgaccgtggaggctgtgagcagcgatgtctgaacactctgggcagttaccagtgtgcctgtgagcctggctatgagctgggcccagacagaaggagctgtgaagctgcttgtggtggacttcttaccaaacttaacggcaccataaccacccctggctggcccaaggagtaccctcctaataagaactgtgtgtggcaagtggttgcaccaacccagtacagaatttctgtgaagtttgagttttttgaattggaaggcaatgaagtttgcaaatatgattatgtggagatctggagtggtctttcctctgagtctaaactgcatggcaaattctgtggcgctgaagtgcctgaagtgatcacatcccagttcaacaatatgagaattgaattcaaatctgacaatactgtatccaagaagggcttcaaagcacattttttctcagacaaagatgaatgctctaaggataatggtggatgtcagcacgaatgtgtcaacacgatggggagctacatgtgtcaatgccgtaatggatttgtgctacatgacaataaacatgattgcaaggaagctgagtgtgaacagaagatccacagtccaagtggcctcatcaccagtcccaactggccagacaagtacccaagcaggaaagaatgcacttgggaaatcagcgccactcctggccaccgaatcaaattagcctttagtgaatttgagattgagcagcatcaagaatgtgcttatgaccacttagaagtatttgatggagaaacagaaaagtcaccgattcttggacgactgtgtggcaacaagataccagatccccttgtggctactggaaataaaatgtttgttcggtttgtttctgatgcatctgttcaaagaaaaggctttcaagctacacattctacagagtgtggcggacgattgaaagcagaatcaaaaccaagagatctgtactcacatgctcagtttggtgataacaactacccaggacaggttgactgtgaatggctattagtatcagaacggggctctcgacttgaattatccttccagacatttgaagtggaggaagaagcagactgtggctatgactatgtggagctctttgatggtcttgattcaacagctgtggggcttggtcgattctgtggatccgggccaccagaagagatttattcaattggagattcagttttaattcatttccacactgatgacacaatcaacaagaagggatttcatataagatacaaaagcataagatatccagataccacacataccaaaaaataacaccaaaacctctgtcagaacacaaaggaatgtgcataatggagagaagacatattttttttaaaactgaagatattggcacaaatgttttatacaaagagtttgaacaaaaaatccctgtaagaccagaattatctttgtactaaaagagaagtttccagcaaaaccctcatcagcattacaaggatatttgaactccatgcttgatggtattaataaagctggtgaaagggcatcatatacttcaaggaagactctacaagcttttgttcacagcttgaaatagatgcctcacaattcagacagtttaattcaggaactgtgaccctgcagtgttctttttgacaatttgtcaagatttagggacataaaatgatcttgcaggtcgtaaactggaaaacagtattttggttgtcttaggataattgctgactttgtatcttggatacagtgtaaaccagatccatataaggtgaatgtgaaatgggagtcttctgagggtgatttgtactttccatgtgtatgtgtgtgtctggtgtttggaaactgggatatttcagcttcattatttccacttgcaggccagcttaacctctgaaacacaaatgatcttgagaccactttagtgtacttacatttagatgagtttgaaatctcaatggtgtctaattattgcagttaaattctagacatcagttctttaagtctcagaaaacgcccagtgaattggtaaacttagttcttttttttggaagtgctgccttttcacaccaaatccaagaagcctgtgatgtcttatgaaccttatgagaaaactccgaagaggtgtgagcaggattcttctgaatgactgtctggatggttcattactcaagttactgctgctgctattgtctttcctttgttgtcgatctgttattgttgtattattattgttgatgttgtcatggttaatctattttttaaaattgaaatgaagcagaagtaggccttgtgagaactgaaaggtctctttcatttttctcttcctgggattcattttttcaaaacacaatgctggaaaaaaaagatttgtttctgaaagacttcttatggtgctattccataaactttttttcaaacaagtttttgacctttgagccaacccacc

SEQ ID NO: 191639 - DNA, 6756 bp, Homo sapiens
  Payload ID: 17860
  Gene Name: tolloid-like 2
  Uniprot ID: Q9Y6L7
  ENST ID: ENST00000357947
  CDS Start-End: 227-3274
gcagcctcggccgccgggcaagtagctccgagcggctgcttcccggttgcctcgacgaagacagggggcgccgcgctccgcttgctccgcgcctgagccatgcccagcagccctgtgtaaccaccgagtcccggccggagccgaccgacccagtgtgcgccgtctttcggccgagctgagctttcgtgcacgcaactccctctgccccagccggccccgcgccaccatgccccgggcgactgcacttggggccctggtgtcactgctgctgctgctgccgctgcctcgcggcgccgggggactcggggagcgcccggacgccaccgcagactactcagagctggacggcgaggagggcacggagcagcagctggagcattaccacgacccttgcaaagccgctgtcttttggggagacattgccttagatgaagatgacttgaagctgtttcacattgacaaagccagagactggaccaagcagacagtgggggcaacaggacacagcacaggtgggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcatagaaaggacggatgaggaaagctttattgtattcagttacagaacctgtggctgttgctcctatgttgggcgccgaggaggaggcccacaggccatatccattgggaagaactgtgacaagtttggcattgtggctcacgagctgggccatgtggttgggttttggcatgaacacacccggccagacagagaccaacatgtcaccatcatcagggaaaacatccagccaggtcaggagtataatttcttaaaaatggaagctggggaagtgagctctctgggagagacatacgactttgacagcatcatgcactacgcccggaacaccttctcaagaggagttttcttagacaccatccttccccgtcaagatgacaatggcgtcaggccaaccattggccagcgcgtgcggctcagtcagggagacatagctcaagcccggaagctgtacaaatgcccagcgtgtggggagaccctgcaggacacaacgggaaacttttctgcacctggtttcccaaatgggtacccatcttactcccactgcgtctggaggatctcggtcaccccaggggaaaagatcgtattaaacttcacatccatggatttgtttaaaagccgactgtgctggtatgattacgtggaggtccgggatggttactggagaaaagccccccttttgggcaggttttgtggcgataagatcccggagcccctcgtctccacggacagccggctctgggtggagttccgcagcagcagcaacatcttgggcaagggcttctttgcagcgtacgaagctacctgcgggggagacatgaacaaagatgccggtcagattcaatctcccaactatccggatgactacagaccttccaaggaatgtgtctggaggattacggtttcagaggggtttcacgtgggacttaccttccaagcttttgagattgaaaggcacgacagctgtgcatatgactacctggaagtccgggatggccccacggaagagagtgccctgatcggccacttttgtggctatgagaagccggaggatgtgaaatcgagctccaacagactgtggatgaagtttgtgtccgatggctctatcaataaagcgggctttgcagccaattttttcaaggaggtggatgagtgttcctggccagatcacggcgggtgcgagcatcgctgtgtgaacacgctgggcagctacaagtgtgcctgtgaccctggctacgagctggccgccgataagaagatgtgtgaagtggcctgtggcggtttcattaccaagctgaatggaaccatcaccagccctgggtggccgaaggagtatcccacaaacaaaaactgtgtctggcaggtggtggcccccgctcagtaccggatctcccttcagtttgaagtgtttgaactggaaggcaatgacgtctgtaagtacgactttgtagaggtgcgcagcggcctgtcccccgacgccaagctgcacggcaggttctgcggctctgagacgccggaggtcatcacctcgcagagcaacaacatgcgcgtggagttcaagtccgacaacaccgtctccaagcgcggcttcagggcccacttcttctcagataaggacgagtgtgccaaggacaacggcgggtgtcagcatgagtgcgtcaacaccttcgggagctacctgtgcaggtgcagaaacggctactggctccacgagaatgggcatgactgcaaagaggctggctgtgcacacaagatcagcagtgtggaggggaccctggcgagccccaactggcctgacaaataccccagccggagggagtgtacctggaacatctcttcgactgcaggccacagagtgaaactcacctttaatgagtttgagatcgagcagcaccaggaatgtgcctatgaccacctggaaatgtatgacgggccggacagcctggcccccattctgggccgtttctgcggcagcaagaaaccagaccccacggtggcttccggcagcagtatgtttctcaggttttattcggatgcctcagtgcagaggaaaggcttccaggcagtgcacagcacagagtgcgggggcaggctgaaggctgaagtgcagaccaaagagctctattcccacgcccagtttggggacaacaactacccgagcgaggcccgctgtgactgggtgatcgtggcagaggacggctacggcgtggagctgacattccggacctttgaggttgaggaggaggccgactgcggctacgactacatggaagcctacgacggctacgacagctcagcgcccaggctcggccgcttctgtggctctgggccattagaagaaatctactctgcaggtgattccctgatgattcgattccgcacagatgacaccatcaacaagaaaggctttcatgcccgatacaccagcaccaagttccaggatgccctgcacatgaagaaatagtgctgatgttcttgaaagacagaaactgagaattttttttgttttgttttgtttttaacaacaatagcaccttgaaaatctgccctaaaacagtgtacagtatttttctcaaacaaaaactcagaatccagccttagaggtatatatttgaatgaaagtcttgtaagtttggccaacaaggtggagagaaaaatgttcttttgcttctgtctgcaatgttatcattcatgaactgttaaagtgttaaagattaggattgaagtcactgaccattccggctatgcttcttcataccattctccttgtcccttgctcctatgtggcaaaaggtcagccttggggttggccgttcctctaatctggacttgcttgcaaaggtgccaggctgtcttctgtccatgttgggcataagggatgaaaacttggccgagactaatgtgtggcccacagctttggctggaatcattttctttctctctgccagggacatgtcaaccaagaaacctgaaaatatggatggatgtcaggactaaaaaaaggcatcacagtgagcagtgagcacagagggagtttcgagtataagaatcattgtcatgaagttaggagaccacaaagccatttctcagagtcattcactctccttgtccctttggtttccccccctccctaattgcagtgggggctaaggcatccattatgaatacagcagaacatttgctggcgagagtcctgtctgctgagaagacaatattgtggctcgtcctgatatttttttcattcattgactttgagaagactccacctgtgcttggaattccatgggcttcaaagaacatttcttcttttagctttggaggcacttgccgtggcacacctggactccttgacatccaattcaaactgcatttgcaaaatgtgcaaagacctcttatgagggaccaattcaggtcccttatggggtgaacactgttgaagactggttaattataagttatgtaagaatcatcgccttgtggaacaagtcaatcagtgactagcttcctgtagccaatcaggttaaagagtgcgttggtaactttgctctgattaactagtattcaatcaccaacttgcaaacagaattcataacacttggcacttgttctagagaagtgtagaggatgatgtttacataattttagcacctcaaggtataatttaaacagtgaggtagttttgaatggcatttcattaaggcatctatgggcattatgagctaaaagctgtggtatgttagctttaaaagagtatttatgttggaataatttttaaataatgtttacataactgtaagtcctgtttggttgttgttggacgcagggcggcacatgagtgtttttggttagagccaagatagctcccatgcaccggaattcctttgggatgaatcagcatcattttaaacaaagtatatgtaaaaggtgaaaggttatattttttacagatcagaatgtggcaccagaggactgtgtctcattaaagtgattgctgggagcaaaaactagaatgatacaaagaaaggtcagagaaatgcatgggaatattttttccttaaaacagaaaaaaattaaagtattattaataatatatgtctgtatatatgtatgtatgtaaaagatcagctgtcaaagccttaatcaatgcagtgtggaaaatgccaacccctggtcctcgctttactgtgggccctgcaggactggctctccatttcctgcctctcctttcaccaagctctgttttggcctttctcggccctggactgaggctcagcctacacgctcatattgtgcatatggcagaccctgcccagcgtgcgctttgatacagcaaatggagcagctgacctcatggctccaatcccacctgcctgttagggtagattccatttatctgatttttgtattttctgaggttttatttggtctcatcttgtctatgagagttgaaactggaactgggaaacctaagatgggtgttatggttctttctccaaggaaataaaaattctgcagttttaacctttagaagtctaagcaagattaacaaatttcatagaaaagtgggagggagtcagaaacagagttggtgctgctcagcaggacggtgaaacaatgatacttctttttatctctttagtatgaacattttcaaaaacacacagcttcaacaattgtcaccatatggccaatttgcaacaatgggactcttatgaaaaacctttatttaggccttctgtgtgacgtatccacagaaaagagaagctctgattcagctggggctagctgggccgctcctctggaagcccacacttgtggggacttaggcatgacacaggttcttgcaaagaaactagaggctggcttcactagagagagtccattcagcagaaagtcccaggcctctgccttggtgcttccaattatcagtgacctgcctgcaagcatccccagaagcaaacagcagaggtagaagatatcactgcagcctgctttgtgctttaattgggtaccaagctttggggatgacagtgagttgcaagaatagttttagttcagagaattgtcttaggacaacaggctaatgaaggatttggggtctgggtttttagcctggctccgttctggtgtaacccggtctagcaaaagctaagcctggattgcagggcaggaaaaaatctggaattaactttagccagtggaatttcttcaaacagagaaagagaggctgttcattgatccactattccctctattttcctctaaggtaaatatttagaggtatttacctgtaaggtgaagtttcctttttatttctactttacaatttctctctaaagcaagcttgtccaacccttggcccaggacggctttgaatatggcccgacacaaattcgtaaactttttaaaaaacattgtaagattctttctgtgatttttttttttctcgtcagctatcgttagtgtattttatgtgtggcccaagataattcttcttccaatgtggcccagggaagccaaaagatgggacacccctgctgtaaagtttcatatcactcatgaattgctcagctgatttaaataatttgtaaaatcctgctaactagcaaattcacattgagattttctattgattgggtccctttgatagctttcagattggtattgttagcgttccatttgtgaacaaatgttcccttggctttagcagatgtttttaaagtttcttttgtagaccgaacttctgaagagtaataccaaatgcctaaaattttatttttaaaaaggaaaattgtttaaagtattatatgtaaacatatgggtattttttattttgtgtaattttacatttcatgaaatgatgtcagtttcaaagagaaagtggagaggacctaacatatgtctctacctagaacggatggtttcattaaagaatgtggatttatt

SEQ ID NO: 191640 - DNA, 4502 bp, Homo sapiens
  Payload ID: 17861
  Gene Name: tonsoku-like, DNA repair protein
  Uniprot ID: Q96HA7
  ENST ID: ENST00000409379
  CDS Start-End: 31-4167
gggaagtccggatcccgcggcgatccgagcatgagcctggagcgcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactacgggagctcagtgtagctgaagatgaagatgaggaggaggaggcggaggaggcggcagccacagcggagagcgaagccctggaggccggcgaggtggagctctcagagggcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggccggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctc

SEQ ID NO: 191641 - DNA, 1713 bp, Homo sapiens
  Payload ID: 17861
  Gene Name: tonsoku-like, DNA repair protein
  ENST ID: ENST00000613741
  CDS Start-End: 240-1673
cagcagtgacttccttccacactcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgagccttggggattctgcaaaacctttgctgctttgctctccaggtcctccaagacctgggagactttttggctgccaagcgagccctgaagaaggcctacaggctgggctcccagaagcctgtgcagagggcagccatctgtcagaacctccagcatgtgctgcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggcccgatgcctacgagctgctggccccgtgcttccagaaagcgctcagctgtgcccagcaggcccagcgtccccagctgcagaggcaggtcttgcagcatctccataccgtgcagctgagagccccagggcccctgagaccgaaaccagactacgggagctcagtgtagctgaagatgaagatgaggaggaggaggcggaggaggcggcacacagcggagagcgaagccctggaggccggcgaggtggagctctcagagggcgaggacgacaccgatggcctgaccccgcagctggaggaggacgaggagcttcagggccacctgggccggcgaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaaggcctcagcccgctggagacgctgcagcagtgggtgaagctgtaccgcagggacctggacctggagacgcggcagaa

SEQ ID NO: 191642 - DNA, 6775 bp, Homo sapiens
  Payload ID: 17862
  Gene Name: TOPBP1-interacting checkpoint and replication regulator
  Uniprot ID: Q7Z2Z1
  ENST ID: ENST00000268138
  CDS Start-End: 106-5838
gggtcccaaaggaaagcagtgagtggtgctgtttccctgaaggaagggactaagggacggtggcgcgggcccggaccggggccccggggcggcggcacggccgatatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctgcttctcctgttccagagtgggcccagcaggagcttggccacaccactccctggagtccagctgttgtggaaaagtggtttcctttctgtaacatcagtggtgccagttccgatttgatggagtcatttgggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtgaactgcctgaatcaagtaaaaagtagtctcttaaaaactagtaaaagtcttcgacagaatctaggaaaaaaactggataaggaagacaaagttagagagtgccagcttcaggtatttcttcgtttggagatgtgtctgcaatgcccttcaataaatgaaagtacagatgatatggaacaagtagtggaggaggtgacagatttgctgcgcatggtgtgtttaactgaggattcagcgtacctagcagagtttctggaggaaattttgagattgtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaa

SEQ ID NO: 191643 - DNA, 6656 bp, Homo sapiens
  Payload ID: 17862
  Gene Name: TOPBP1-interacting checkpoint and replication regulator
  Uniprot ID: Q7Z2Z1
  ENST ID: ENST00000560985
  CDS Start-End: 1-5730
atggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctgcttctcctgttccagagtgggcccagcaggagcttggccacaccactccctggagtccagctgttgtggaaaagtggtttcctttctgtaacatcagtggtgccagttccgatttgatggagtcatttgggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtgaactgcctgaatcaagtaaaaagtagtctcttaaaaactagtaaaagtcttcgacagaatctaggaaaaaaactggataaggaagacaaagttagagagtgccagcttcaggtatttcttcgtttggagatgtgtctgcaatgcccttcaataaatgaaagtacagatgatatggaacaagtagtggaggaggtgacagatttgctgcgcatggtgtgtttaactgaggattcagcgtacctagcagagtttctggaggaaattttgagattgtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggtttttt

SEQ ID NO: 191644 - DNA, 2367 bp, Homo sapiens
  Payload ID: 17862
  Gene Name: TOPBP1-interacting checkpoint and replication regulator
  ENST ID: ENST00000561095
  CDS Start-End: 1-644
gctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatgggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctggga

SEQ ID NO: 191645 - DNA, 3738 bp, Homo sapiens
  Payload ID: 17863
  Gene Name: topoisomerase (DNA) I
  Uniprot ID: P11387
  ENST ID: ENST00000361337
  CDS Start-End: 251-2548
agcccaaatgcgaacttaggctgttacacaactgctggggtctgttctcgccgcccgcccggcagtcaggcagcgtcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgacatgagtggggaccacctccacaacgattcccagatcgaagcggatttccgattgaatgattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 191646 - DNA, 1958 bp, Homo sapiens
  Payload ID: 17864
  Gene Name: topoisomerase (DNA) I, mitochondrial
  Uniprot ID: Q969P6
  ENST ID: ENST00000329245
  CDS Start-End: 36-1841
ggcccagcttgtcgctctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaatgtgtgcaagtgcttgtacatcactagaaaaa

SEQ ID NO: 191647 - DNA, 892 bp, Homo sapiens
  Payload ID: 17864
  Gene Name: topoisomerase (DNA) I, mitochondrial
  ENST ID: ENST00000519977
  CDS Start-End: 1-334
ggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttatgctttaggtactgattttctcctctccgcctggctggaacatccgtctgcatcggacgggcttccttctgcacctgtgacctcacaagggctctccttggggaggcaggaccagagcagccctgagtaaccgggcacagccgaggaacaggccccagggaggccaggacccgggtcctcacgcctgcggccacagaagcaccgtgtccctgcagctgtgagccaccaggcgtctgggtgggtggttactcagcaagtgccagtagagaaactgggtcccagagttggggttgctgtggactggatacttgtccctcacctccagttcacatgttaaagtcctcacccccagcaagacagtgttggaggtggggcctttgggaggggagcaggtttagagaagatcctgggggaccctcacgatgagatgagtgccctcatgggaagagacaccggagcctcctctccaggagcacacacgggacggtcacatgagcaagaggctgctgtccgtaagctgggggtggtccc

SEQ ID NO: 191648 - DNA, 906 bp, Homo sapiens
  Payload ID: 17864
  Gene Name: topoisomerase (DNA) I, mitochondrial
  ENST ID: ENST00000522041
  CDS Start-End: 242-906
cactggctgcactgctggacccccttccacccagctcctcggaggcagggctctctcataagcagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataa

SEQ ID NO: 191649 - DNA, 1960 bp, Homo sapiens
  Payload ID: 17864
  Gene Name: topoisomerase (DNA) I, mitochondrial
  Uniprot ID: Q969P6
  ENST ID: ENST00000521193
  CDS Start-End: 364-1875
gagccgtggtgcggtgggaccgcgtgggtcctggaagagctgcagaggagagtgacggctttggatgcgctttgccccagggcctttcttcccggagttggccttttccctgcccttctcttctcctggcgtggtgacctgcctcccttctcctggatcgctttgctggcagccaccttgtaacacctcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaa

SEQ ID NO: 191650 - DNA, 1561 bp, Homo sapiens
  Payload ID: 17864
  Gene Name: topoisomerase (DNA) I, mitochondrial
  ENST ID: ENST00000519139
  CDS Start-End: 434-1561
attcacttagtgcttccagcgtggcatgtctctgtgacctggtggtgcgctatcagcatacccattcacagctgagggcctgcacagctgcctaaggccatgctgcagaaatgtcctgtctgcctgcaggagcttgggacccaaagagagccccagatggggcagggtgtcttgggaggagggagttctggcctgcgcttggagctggggctggctgtgggccctgcattgaggcacatctctccgagggtgcacaggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccgtaagctgggacggccccgcaaaaccacgtaattatagagaccattttcctccccagacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctac

SEQ ID NO: 191651 - DNA, 613 bp, Homo sapiens
  Payload ID: 17864
  Gene Name: topoisomerase (DNA) I, mitochondrial
  ENST ID: ENST00000518760
  CDS Start-End: 121-613
gtgacttatagcagtgcttgagggaagaaaataaattctccgtttcaaaagaaaatccagggcgggacaatcttactgttggatttgcacagatcaccacgccagtgaagactaatcaccatgaaaagccacccaagaaaaaaggccaaaaacagccagaaaggccctttcagaaatgtctgttgcacatgctttcccctctcagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttca

SEQ ID NO: 191652 - DNA, 1461 bp, Homo sapiens
  Payload ID: 17864
  Gene Name: topoisomerase (DNA) I, mitochondrial
  ENST ID: ENST00000518951
  CDS Start-End: 3-506
agatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccgtaagctgggacggccccgcaaaaccacgtaattatagagaccattttcctccccagacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaa

SEQ ID NO: 191653 - DNA, 499 bp, Homo sapiens
  Payload ID: 17864
  Gene Name: topoisomerase (DNA) I, mitochondrial
  ENST ID: ENST00000522043
  CDS Start-End: 6-499
ggcagatgcgcgtggtgcggctgctgcggctccgggcggctctgacgctgctcggggaggtcccccgccgcccggcctcccggggtgtcccgggctcgcgcaggacgcagaagggcagtggagccagaaacagccagaaaggccctttcagaaatgtctgttgcacatgctttcccctctcagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaagga

SEQ ID NO: 191654 - DNA, 1868 bp, Homo sapiens
  Payload ID: 17864
  Gene Name: topoisomerase (DNA) I, mitochondrial
  Uniprot ID: Q969P6
  ENST ID: ENST00000519148
  CDS Start-End: 276-1787
gctcgggccttcccggcgtctccgcgcaggcctcggggaagcggggtccgggggagccgtggtgcggtgggaccgcgtgggtcctggaagagctgcagaggaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaat

SEQ ID NO: 191655 - DNA, 1007 bp, Homo sapiens
  Payload ID: 17864
  Gene Name: topoisomerase (DNA) I, mitochondrial
  ENST ID: ENST00000519591
  CDS Start-End: 403-1007
tggtgcggctgctgcggctccgggcggctctgacgctgctcggggaggtcccccgccgcccggcctcccggggtgtcccgggctcgcgcaggacgcagaagggcagtggagccagacccttcagagacttcctgttgctctgaggacactcatcccagccgaccaggcccaccaggcccccaacagcactacctggctggggtcacgtgcaggtctcctggctctggcaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctga

SEQ ID NO: 191656 - DNA, 1982 bp, Homo sapiens
  Payload ID: 17864
  Gene Name: topoisomerase (DNA) I, mitochondrial
  Uniprot ID: Q969P6
  ENST ID: ENST00000523676
  CDS Start-End: 407-1918
ccggcctcccggggtgtcccgggctcgcgcaggacgcagaagggcagtggagccaggcacaagccgcatggatccagtggccctggtggccgttggtggtcccaggcgctttcctggaggacatgtgagaagccctgccggcgcatactgggcctggggtagccgcatggggatgggtctctgcgcatgaaatgctggagtttccgaagagctggagagttgacagcctcactggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtact

SEQ ID NO: 191657 - DNA, 874 bp, Homo sapiens
  Payload ID: 17864
  Gene Name: topoisomerase (DNA) I, mitochondrial
  ENST ID: ENST00000522121
  CDS Start-End: 1-150
gccactttttatgggaggatgttagatcatgaatacacaacaaaggaggttttccggaagaacttcttcaatgactggcgaaaggctccgcttctggaccctcttctttggcctgatgccacccctctgcctttcacgacagctttgtgaggtggcaccagctgcccggcatcctcattctccctctggtcagcacttcttccagtcactagcagagctaggaagggaggcagtgtcacaaagcagcagaacaggagtgggtggcacatccggcggccccgggagacacagggacggaccctgagcccgtggttgtggccgagcagggctccatcctggcacagatggtgtcgtacctgagctcctcggaagaggcggatcatccccatcccacagcgagacacgtttgacagcagctcctgaggtctcacaggcctaagtggccgagcctggactgggaccgtgagctggtgcccgcaagcctgggcttttgtccatgggctgtgcagagtttttgttgtgtaggaaacgaaaggagaaacagttgcctgtgatctgcggctctccctcaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaa

SEQ ID NO: 191658 - DNA, 509 bp, Homo sapiens
  Payload ID: 17864
  Gene Name: topoisomerase (DNA) I, mitochondrial
  ENST ID: ENST00000518007
  CDS Start-End: 108-509
cagactgcagcccgtgctgatgactgtggctgtgatgaattcgtgcctgtgaccacagctgctctccagatttgcacagatcaccacgccagtgaagactaatcaccatgaaaagccacccaagaaaaaaggccaagtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaa

SEQ ID NO: 191659 - DNA, 564 bp, Homo sapiens
  Payload ID: 17864
  Gene Name: topoisomerase (DNA) I, mitochondrial
  ENST ID: ENST00000520950
  CDS Start-End: 466-564
gtctccgcgcaggcctcggggaagcggggtccgggggagccgtggtgcggtgggaccgcgtgggtcctggaagagctgcagaggagagtgacggctttggatgcgctttgccccagggcctttcttcccggagttggccttttccctgcccttctcttctcctggcgtggtgacctgcctcccttctcctggatcgctttgctggcagccaccttgtaacacctcagactgcagcccgtgctgatgactgtggctgtgatgaattcgtgcctgtgaccacagctgctctccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaag

SEQ ID NO: 191660 - DNA, 698 bp, Homo sapiens
  Payload ID: 17864
  Gene Name: topoisomerase (DNA) I, mitochondrial
  ENST ID: ENST00000523417
  CDS Start-End: 1-370
gctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggttctttgccagacgcacatgctgtgaatgtcatctcccagactttgccttttcacttctcagtgaggtctccaaacagaaaactgtaacttagttatgccgtttatcaatctgtcttttatggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttcc

SEQ ID NO: 191661 - DNA, 5758 bp, Homo sapiens
  Payload ID: 17865
  Gene Name: topoisomerase (DNA) II alpha
  Uniprot ID: P11388
  ENST ID: ENST00000423485
  CDS Start-End: 160-4755
gattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaa

SEQ ID NO: 191662 - DNA, 579 bp, Homo sapiens
  Payload ID: 17865
  Gene Name: topoisomerase (DNA) II alpha
  ENST ID: ENST00000581055
  CDS Start-End: 138-579
gtgacgggtgaagctctggggctgcggtcaggccggcgaccggcttgggagcccatattctccattcccggttccggggtgatcgtggagaggcggaagccccttctggtgctagtagtgaacctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacag

SEQ ID NO: 191663 - DNA, 420 bp, Homo sapiens
  Payload ID: 17865
  Gene Name: topoisomerase (DNA) II alpha
  ENST ID: ENST00000577541
  CDS Start-End: 1-84
gctgtggctcctcgggcaaaatctgtacgggcaaagaaacctataaagtacctggaagagtcagatgaagatgatctgttttaaaatctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgca

SEQ ID NO: 191664 - DNA, 5358 bp, Homo sapiens
  Payload ID: 17866
  Gene Name: topoisomerase (DNA) II beta
  Uniprot ID: Q02880
  ENST ID: ENST00000264331
  CDS Start-End: 76-4956
gcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgactctttttgatcagaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgc

SEQ ID NO: 191665 - DNA, 2049 bp, Homo sapiens
  Payload ID: 17866
  Gene Name: topoisomerase (DNA) II beta
  ENST ID: ENST00000413971
  CDS Start-End: 1-213
gtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtg

SEQ ID NO: 191666 - DNA, 3525 bp, Homo sapiens
  Payload ID: 17866
  Gene Name: topoisomerase (DNA) II beta
  ENST ID: ENST00000424225
  CDS Start-End: 76-3525
gtgtgtgcggtgttatgccggacaagagggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttact

SEQ ID NO: 191667 - DNA, 5389 bp, Homo sapiens
  Payload ID: 17866
  Gene Name: topoisomerase (DNA) II beta
  Uniprot ID: Q02880
  ENST ID: ENST00000435706
  CDS Start-End: 203-5068
tttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactg

SEQ ID NO: 191668 - DNA, 5378 bp, Homo sapiens
  Payload ID: 17867
  Gene Name: topoisomerase (DNA) II binding protein 1
  Uniprot ID: Q92547
  ENST ID: ENST00000260810
  CDS Start-End: 133-4701
ggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacataagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttctgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaa

SEQ ID NO: 191669 - DNA, 618 bp, Homo sapiens
  Payload ID: 17867
  Gene Name: topoisomerase (DNA) II binding protein 1
  ENST ID: ENST00000508524
  CDS Start-End: 1-618
atttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgataatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatcttt

SEQ ID NO: 191670 - DNA, 402 bp, Homo sapiens
  Payload ID: 17867
  Gene Name: topoisomerase (DNA) II binding protein 1
  ENST ID: ENST00000572787
  CDS Start-End: 1-153
ttttttgacagtattgagaaaggtttttgtcaggatgaatccatatacaagacagaacctagaccagaagcaaagactatgcccaattcttcaactcctaccagccagatcaacacaattgatacaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgc

SEQ ID NO: 191671 - DNA, 4056 bp, Homo sapiens
  Payload ID: 17868
  Gene Name: topoisomerase (DNA) III alpha
  Uniprot ID: Q13472
  ENST ID: ENST00000321105
  CDS Start-End: 216-3221
gaagttccacgccaagatactggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctc

SEQ ID NO: 191672 - DNA, 4116 bp, Homo sapiens
  Payload ID: 17868
  Gene Name: topoisomerase (DNA) III alpha
  Uniprot ID: Q13472
  ENST ID: ENST00000542570
  CDS Start-End: 230-3235
ggagaaggcgggcggaagttccacgccaagatactggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaatttaaaaatttaaaaaaataaaaagaatccaaccccgg

SEQ ID NO: 191673 - DNA, 3661 bp, Homo sapiens
  Payload ID: 17868
  Gene Name: topoisomerase (DNA) III alpha
  ENST ID: ENST00000584582
  CDS Start-End: 216-425
gaagttccacgccaagatactggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcgggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtg

SEQ ID NO: 191674 - DNA, 3239 bp, Homo sapiens
  Payload ID: 17868
  Gene Name: topoisomerase (DNA) III alpha
  ENST ID: ENST00000582981
  CDS Start-End: 230-499
ggagaaggcgggcggaagttccacgccaagatactggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccaggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagt

SEQ ID NO: 191675 - DNA, 2929 bp, Homo sapiens
  Payload ID: 17868
  Gene Name: topoisomerase (DNA) III alpha
  Uniprot ID: Q13472
  ENST ID: ENST00000580095
  CDS Start-End: 1-2929
atggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcggtgctggaggccagcagggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagat

SEQ ID NO: 191676 - DNA, 823 bp, Homo sapiens
  Payload ID: 17868
  Gene Name: topoisomerase (DNA) III alpha
  ENST ID: ENST00000461127
  CDS Start-End: 167-586
cacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggtcagtacaattctcaagggaaggactttcagattatagcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtga

SEQ ID NO: 191677 - DNA, 575 bp, Homo sapiens
  Payload ID: 17868
  Gene Name: topoisomerase (DNA) III alpha
  ENST ID: ENST00000585031
  CDS Start-End: 197-484
ctggattcggtgctgaggcggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggctggagtgcagtggcacaatcttgactcattgtaacctccacctcccgggttcaagcgattctcctgcctcagactcccgagtagctgggactacagagctgcaaccctcttgtcctctttgaagc

SEQ ID NO: 191678 - DNA, 503 bp, Homo sapiens
  Payload ID: 17868
  Gene Name: topoisomerase (DNA) III alpha
  ENST ID: ENST00000493648
  CDS Start-End: 1-157
gacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcaggtggtggccatgttcccccgtttgccttcacaaaaaccttgtgaataatacaagccatatggactctgatttacagtttagaagatgagcagaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaa

SEQ ID NO: 191679 - DNA, 582 bp, Homo sapiens
  Payload ID: 17868
  Gene Name: topoisomerase (DNA) III alpha
  ENST ID: ENST00000489131
  CDS Start-End: 1-76
agcaaagaaaccccggaaatgcagcctttgccaccagcctggacacacccgtcccttttgtcctcagaacagatgagctcaggtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctct

SEQ ID NO: 191680 - DNA, 553 bp, Homo sapiens
  Payload ID: 17868
  Gene Name: topoisomerase (DNA) III alpha
  ENST ID: ENST00000582122
  CDS Start-End: 1-402
tttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtcagtggctcctctgggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggccca

SEQ ID NO: 191681 - DNA, 766 bp, Homo sapiens
  Payload ID: 17868
  Gene Name: topoisomerase (DNA) III alpha
  ENST ID: ENST00000581536
  CDS Start-End: 1-490
cagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaaggggagatgaacagcgactgtacgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggacggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacc

SEQ ID NO: 191682 - DNA, 2863 bp, Homo sapiens
  Payload ID: 17869
  Gene Name: topoisomerase (DNA) III beta
  Uniprot ID: O95985
  ENST ID: ENST00000357179
  CDS Start-End: 186-2774
gccagaagcggctggacccggaaataggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccaga

SEQ ID NO: 191683 - DNA, 3107 bp, Homo sapiens
  Payload ID: 17869
  Gene Name: topoisomerase (DNA) III beta
  Uniprot ID: O95985
  ENST ID: ENST00000398793
  CDS Start-End: 436-3024
ggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatctta

SEQ ID NO: 191684 - DNA, 571 bp, Homo sapiens
  Payload ID: 17869
  Gene Name: topoisomerase (DNA) III beta
  ENST ID: ENST00000437103
  CDS Start-End: 446-571
ataggggttgtcggtagccgccccgggaacaaggaccggagctggatccgcggtgcggctgtgggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggtagttttttcttgtttttaatctcagatgtcttcaagtttccctaattccctaatttttcttcttcttgcctcaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacact

SEQ ID NO: 191685 - DNA, 400 bp, Homo sapiens
  Payload ID: 17869
  Gene Name: topoisomerase (DNA) III beta
  ENST ID: ENST00000442653
  CDS Start-End: 261-400
ttgtttttaatctcagatgtcttcaagtttccctaattccctaatttttcttcttcttgcctcaggttggtcttgttttttctttgttaaagtgattttccttgtagtggtgtaggttctattgacagcattgctatcctgagtgtcttttcttctctttaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctgg

SEQ ID NO: 191686 - DNA, 736 bp, Homo sapiens
  Payload ID: 17869
  Gene Name: topoisomerase (DNA) III beta
  ENST ID: ENST00000434517
  CDS Start-End: 673-736
ccccgggaacaaggaccggagctggatccgcggtgcggctgtgggtgagcggcgggctgcgggaccctcgcccggcggctcagaaaggcgggaagcgcacgcatttttctggcttgtttcctgaacgttggccggcggaggacccgcgagctcgggagagcgcccgggccgggctctgcattcttgttgcctcttccctggcgggggtgatactctcccgcggggcttgctgtgggggttcagggaggtggagatgggcccgccatgtgcctgcagggagcaggcgctgtggttaatacttttcttcttcgaaccctcccacagctctttagggtgagatctgctgtaccagtctcacaggtagggaaactgaggctcagggaagctgtgcagccaccggggcccagatcggtgcggtacacacccaggcagcttccactcgccgccccctaggccctggctgggttttgagggcacccaggttctctgacctgttatctgtaaatgaagtagggtacttttgtgaacaaattagctggaatccaggggcaataatttctcgcagaagtgaaaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctct

SEQ ID NO: 191687 - DNA, 824 bp, Homo sapiens
  Payload ID: 17869
  Gene Name: topoisomerase (DNA) III beta
  ENST ID: ENST00000424393
  CDS Start-End: 87-824
gtagccgccccgggaacaaggaccggagctggatccgcggtgcggctgtggtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgaggttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaag

SEQ ID NO: 191688 - DNA, 561 bp, Homo sapiens
  Payload ID: 17869
  Gene Name: topoisomerase (DNA) III beta
  ENST ID: ENST00000456075
  CDS Start-End: 379-561
aacaaggaccggagctggatccgcggtgcggctgtggctctttagggtgagatctgctgtaccagtctcacaggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtg

SEQ ID NO: 191689 - DNA, 4163 bp, Homo sapiens
  Payload ID: 17869
  Gene Name: topoisomerase (DNA) III beta
  ENST ID: ENST00000444502
  CDS Start-End: 160-549
ggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggtagagtctgcctctggcctgcccctcaccagaggggtgtctctctgtcagcaaggccagtacctggggacccaggtccccacgtgggaccagctcccagatctgggcttcaggcctccgtaggccaggtcagtgacacctcctggctgggttgaaagagcaggtgcattaacaccacacatggccaggaacacgtgcctctgacgcacagggctgctgccctgccgtgctgccaggacagtagaaaccaccgcctatagggaccctttcacactcagacccttgaccacgtgttgcggagccttttgctggggactgggagggagatgactcctgcactctgcttgcccgcaggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctgccttgcaccaggctggactctgaggggacccctcaccctggcctttcctgcactcattggcactgagacgagagaccctggatgtagctggggcactgcttaggcctcagccagtggtgccaccctctctctgtgtcagaatcgagcaggcaaccctagtccaccctcaggacctgggcacaggtgtgcagtgctccctctggagctgagtgagcaagaggatgcagcagtcgggggacccacccggtgagcgggcacccccagtcagcgtccaccaccgtcctccatcctcatcctcgtcctcattactggaggagggagcgcatgtccaggcaggcaggacagagcaccgagccagaccaggaatcagcgggagtgaggcatctgcccacattcaccgtgtgctctgcagaaagctccctcaggcctcagtctgcacccaggctgccccgggagtgagaccccatccctgccctcctgctgccgccagagtagctgacagggtggttccatgtggcccagtgacatgagggtcatgtggcattaccagtaacaagctggcagcaaagcaaaggggggatggagtcagctgaaacccactgggatggtgccagcgaggggccttgaaagttgaggaggtttcaggtaagcagaaaacaggggtaatggcagccaggagccgaaacatgagcaaggctgtccccaagagcaaggccaagaagagttccttctgctgggacgagggatccaggagcttgaggcattgggagcaggcagcagagggcaggtgggcacagtgggcgtgcctttacagggctcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatctta

SEQ ID NO: 191690 - DNA, 3061 bp, Homo sapiens
  Payload ID: 17869
  Gene Name: topoisomerase (DNA) III beta
  ENST ID: ENST00000457179
  CDS Start-End: 160-549
ggggttgtcggtagccgccccgggaacaaggaccggagctggatccgcggtgcggctgtgggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggggagaacatctgctttgagaaatgaagccacttattcccagtaaggaagctgcgtggccaggctccggcggcgaccctagtcccactgcacggccttcctagttcttgatgctgttctgcccgtcatgaacaaggcccatggtggcgagaagaccgtgttccgggccaggtttagctccatcacggacacagacatctgtaatgccatggcctgcctaggcgagcctgaccacaacgaggcgctctcagtggatgctcgccaggagctggacctgcgaatcggctgtgcattcaccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggtcacaccacgggcccagccttcctcctctgtgccttcatgggcagacaaacattctacatcgtgtctggggatgggaggcccagggtctgaggccccggccacccaggctggggaccctgagtggcggcgcatatctctccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatcca

SEQ ID NO: 191691 - DNA, 550 bp, Homo sapiens
  Payload ID: 17869
  Gene Name: topoisomerase (DNA) III beta
  ENST ID: ENST00000437929
  CDS Start-End: 185-550
aacaaggaccggagctggatccgcggtgcggctgtggatgtcttcaagtttccctaattccctaatttttcttcttcttgcctcaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagggg

SEQ ID NO: 191692 - DNA, 543 bp, Homo sapiens
  Payload ID: 17869
  Gene Name: topoisomerase (DNA) III beta
  ENST ID: ENST00000449704
  CDS Start-End: 364-543
gttgtcggtagccgccccgggaacaaggaccggagctggatccgcggtgcggctgtgggtgagtccacctgtaggtggaagagccagtccagagaggagggccaggcatccacctggcctgacccatcactccagatccccaggccccagcatcttcctagcatggatttaggaataaaattgacctgagatcactggggccacttcaccttcccccaaatggagccacattcccaggatcatctcagccacttcagctgacctggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcac

SEQ ID NO: 191693 - DNA, 2956 bp, Homo sapiens
  Payload ID: 17869
  Gene Name: topoisomerase (DNA) III beta
  ENST ID: ENST00000457270
  CDS Start-End: 1-1577
atttagacagctctctcatctcctttgggccgtgtcagactccaaccctgggattctgtgtggagagacatgataaaatccagtccttcaaaccagagacctactgggtgctgcaggccaaggttaacactgacaaagacagatctctccttttggactgggaccgagtaagagtgtttgaccgggagatcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctgccttgcaccaggctggactctgaggggacccctcaccctggcctttcctgcactcattggcactgagacgagagaccctggatgtagctggggcactgcttaggcctcagccagtggtgccaccctctctctgtgtcagaatcgagcaggcaaccctagtccaccctcaggacctgggcacaggtgtgcagtgctccctctggagctgagtgagcaagaggatgcagcagtcgggggacccacccggtgagcgggcacccccagtcagcgtccaccaccgtcctccatcctcatcctcgtcctcattactggaggagggagcgcatgtccaggcaggcaggacagagcaccgagccagaccaggaatcagcgggagtgaggcatctgcccacattcaccgtgtgctctgcagaaagctccctcaggcctcagtctgcacccaggctgccccgggagtgagaccccatccctgccctcctgctgccgccagagtagctgacagggtggttccatgtggcccagtgacatgagggtcatgtggcattaccagtaacaagctggcagcaaagcaaaggggggatggagtcagctgaaacccactgggatggtgccagcgaggggccttgaaagttgaggaggtttcaggtaagcagaaaacaggggtaatggcagccaggagccgaaacatgagcaaggctgtccccaagagcaaggccaagaagagttccttctgctgggacgagggatccaggagcttgaggcattgggagcaggcagcagagggcaggtgggcacagtgggcgtgcctttacagggctcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatcca

SEQ ID NO: 191694 - DNA, 582 bp, Homo sapiens
  Payload ID: 17869
  Gene Name: topoisomerase (DNA) III beta
  ENST ID: ENST00000430142
  CDS Start-End: 219-582
agaagcggctggacccggaaataggggttgtcggtagccgccccgggaacaaggaccggagctggatccgcggtgcggctgtggctctttagggtgagatctgctgtaccagtctcacaggagtcagcattggtaatagtgctgtgctgcggaagagtggagtctaaactttttcattgccagtgccccgaaactggagtgtgaaggaccgagacaaaatgaagactgtgctcatggttgctgaaaagccgtccttggcacagtcaattgccaaaatcctctctagagggagcctgtcctcacacaaagggctgaacggggcctgctcagtccacgagtacactgggacctttgctggccagccagtgcgcttcaagatgacgtctgtctgtggtcacgtgatgaccctggatttcctgggaaaatacaacaaatgggacaaagtggaccccgcagaactgttcagccaagctcccacggagaagaaagaagctaaccccaagctgaacatggtgaagttcctgcaggtggagggcagaggctgcgactacatcgtgctgtggctggactgcgacaaggagg

SEQ ID NO: 191695 - DNA, 2890 bp, Homo sapiens
  Payload ID: 17869
  Gene Name: topoisomerase (DNA) III beta
  ENST ID: ENST00000436282
  CDS Start-End: 1-507
atcgcacagatgtttttaaacatgacaaagctggagaaggaagcccaggtggaggccacaagcaggaaagaaaaggccaagcagaggcccctggccctgaacactgtggagatgctgcgtgtggccagctcttctctgggcatggggccgcagcacgccatgcagacggctgagcggctctacacgcaaggctacatcagctacccacggacagagaccacccactaccctgagaactttgacctgaagggctctctgcggcagcaggccaaccacccctactgggccgacacggtgaagcggttgttagcagaaggtatcaaccgcccgcggaaaggccatgacgccggcgaccatccccccatcacccccatgaagtctgccacagaggccgaattaggatttgcagtgtgtcctgcacagcggctctgtaagcaggagcttgctgctcgagcgagagtactgggggctcctcacggccagagcccccagctggctcccaactgactagccctggcctgttgcagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggcacggatgccagcatccctgtgcatatcaacaacatctgccagcgcaactatgtcacggtggagagcgggcgccggctcaagcccaccaacctcggcatcgtcctggtgcacggctactataagattgatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggcatggatgagttgatggaggtgtctttctcgcccctggcggccacaggcaagcccctctcacgctgtgggaagtgccaccgcttcatgaagtacatccaggccaagccaagccgcctgcactgctcccactgcgatgagacctacacgctcccccagaacggcaccatcaagctctacaaggagctccgctgccctctggatgacttcgagctggtcctgtggtcatcaggctctcggggcaagagctacccgctgtgcccctactgctacaaccacccacccttccgagacatgaagaaaggtgagtgcagccactccctcctgtccacaggtagctgcagtctcttttcagtgccaacccctgccttgcaccaggctggactctgaggggacccctcaccctggcctttcctgcactcattggcactgagacgagagaccctggatgtagctggggcactgcttaggcctcagccagtggtgccaccctctctctgtgtcagaatcgagcaggcaaccctagtccaccctcaggacctgggcacaggtgtgcagtgctccctctggagctgagtgagcaagaggatgcagcagtcgggggacccacccggtgagcgggcacccccagtcagcgtccaccaccgtcctccatcctcatcctcgtcctcattactggaggagggagcgcatgtccaggcaggcaggacagagcaccgagccagaccaggaatcagcgggagtgaggcatctgcccacattcaccgtgtgctctgcagaaagctccctcaggcctcagtctgcacccaggctgccccgggagtgagaccccatccctgccctcctgctgccgccagagtagctgacagggtggttccatgtggcccagtgacatgagggtcatgtggcattaccagtaacaagctggcagcaaagcaaaggggggatggagtcagctgaaacccactgggatggtgccagcgaggggccttgaaagttgaggaggtttcaggtaagcagaaaacaggggtaatggcagccaggagccgaaacatgagcaaggctgtccccaagagcaaggccaagaagagttccttctgctgggacgagggatccaggagcttgaggcattgggagcaggcagcagagggcaggtgggcacagtgggcgtgcctttacagggctcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgagacgcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatctt

SEQ ID NO: 191696 - DNA, 4098 bp, Homo sapiens
  Payload ID: 17870
  Gene Name: topoisomerase I binding, arginine/serine-rich, E3 ubiquitin protein ligase
  Uniprot ID: Q9NS56
  ENST ID: ENST00000360538
  CDS Start-End: 118-3255
tgaagaaatagggcctttccgcctgcgggcccagtgagtcgacacggtgggggcccgcgatccccgggacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcata

SEQ ID NO: 191697 - DNA, 3621 bp, Homo sapiens
  Payload ID: 17870
  Gene Name: topoisomerase I binding, arginine/serine-rich, E3 ubiquitin protein ligase
  Uniprot ID: Q9NS56
  ENST ID: ENST00000379858
  CDS Start-End: 118-3060
tgaagaaatagggcctttccgcctgcgggcccagtgagtcgacacggtgggggcccgcgatccccgggacttaccactgaataaatccagtccagcgtgcgacgacttactggcttcatgataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaac

SEQ ID NO: 191698 - DNA, 727 bp, Homo sapiens
  Payload ID: 17871
  Gene Name: TOR signaling pathway regulator
  Uniprot ID: O75663
  ENST ID: ENST00000367830
  CDS Start-End: 24-560
cctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattcctggtggcgggcacctgtagtcccagctactcgggaggctgaggcaggagaagcgtgaacccgggaggcggagcttgcagtgagctgagatcgcaccactgcactccagccctccagcctgggcgacagagcaagactccgtctcaaaaaaaaaaaataaaataaaataaaagaagtagaaaacaca

SEQ ID NO: 191699 - DNA, 3032 bp, Homo sapiens
  Payload ID: 17871
  Gene Name: TOR signaling pathway regulator
  Uniprot ID: O75663
  ENST ID: ENST00000367833
  CDS Start-End: 146-964
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctgtttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaaatttagacttagtaccagaaccaaaaatacctagatttttggagaacttattacatacatagaaacatgaatatggtttaccactgtgtgtgtgtaggatgttagaattatctgtcctccatctttaggtgctttttcttaaatgtggttctacttatactgatatttttaatttccatcttccatgcaacctcagagtgaataaaccccttaaatttggtgctggttcgaaaaagtctaaagggtttattaggggttgtttttcgcaaatattacatcaatccttaaagcaacaagattaattttctgcttaaaatatttgggaagataggtaaggaggagggggttttaaaatataaaagcaagtttttctattttaaggtgcatatttgtaacattacaggggatgaagtaaaatgtaattaattagcacaagacttagggagtacagaaaatacacagaagtaaatttcaaatccatttgattgttttcatagtgaccccttagtcattttatattcttgtctgcctttctagaaaaatggttgtcataaagtggaaagtgattaaaaagcatcaaataagaaattatttcaagtggatttttaaaaatatttttttgaagggcagggggaaaattcaccccttttctgatttgaaatatgttgtacatatttccatttgatggataaatcattaagtaagaatatttgatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgccttttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgtaagaggagaataaacaataaggaattactgatcaaa

SEQ ID NO: 191700 - DNA, 3044 bp, Homo sapiens
  Payload ID: 17872
  Gene Name: torsin A interacting protein 1
  ENST ID: ENST00000271583
  CDS Start-End: 207-2006
acagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaacatcttcaccaggcaagagttcaatatatggcagtttttcagatgatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaa

SEQ ID NO: 191701 - DNA, 3397 bp, Homo sapiens
  Payload ID: 17872
  Gene Name: torsin A interacting protein 1
  ENST ID: ENST00000435319
  CDS Start-End: 171-1559
aagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctct

SEQ ID NO: 191702 - DNA, 888 bp, Homo sapiens
  Payload ID: 17872
  Gene Name: torsin A interacting protein 1
  ENST ID: ENST00000447964
  CDS Start-End: 1-888
ataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctgga

SEQ ID NO: 191703 - DNA, 593 bp, Homo sapiens
  Payload ID: 17872
  Gene Name: torsin A interacting protein 1
  ENST ID: ENST00000527391
  CDS Start-End: 1-593
ccttcagcagcagcactcagagcagcctccgctacagccgtctcctgttatgaccaggagagggctgcgggactctcattcctctgaaggtgaggaccgcggagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgacagcattctgaaatcagagcttggaaaccagtcaccatcaacctccagccgac

SEQ ID NO: 191704 - DNA, 587 bp, Homo sapiens
  Payload ID: 17872
  Gene Name: torsin A interacting protein 1
  ENST ID: ENST00000529091
  CDS Start-End: 1-191
attcctctgaaggtgaggaccgcggaggtaacagtcccagccgcgagccagggaacgcgcgggggcgggcgcgcgcctcggtggagctcatgcccgcctggtgtggtggtccctgccaaaaatctgccactttggtggccgtcactgtaacctcaagtagtctggcaaatcagactgacaaagtaacctgaaaaacaagactattaattagagttttcgtctaaatggacaaaagggatgctgacaaagtgagtgtatagtgttagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaa

SEQ ID NO: 191705 - DNA, 579 bp, Homo sapiens
  Payload ID: 17872
  Gene Name: torsin A interacting protein 1
  ENST ID: ENST00000531630
  CDS Start-End: 1-579
gaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgac

SEQ ID NO: 191706 - DNA, 3685 bp, Homo sapiens
  Payload ID: 17872
  Gene Name: torsin A interacting protein 1
  Uniprot ID: Q5JTV8
  ENST ID: ENST00000528443
  CDS Start-End: 462-2216
gtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtca

SEQ ID NO: 191707 - DNA, 8704 bp, Homo sapiens
  Payload ID: 17872
  Gene Name: torsin A interacting protein 1
  Uniprot ID: Q5JTV8
  ENST ID: ENST00000606911
  CDS Start-End: 192-1943
caccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctctatgtgttataaacttaatgatttatcatctttaaaaaaagaaatccaagtattttccttgaacaattgtagcaactctggctaggagaaacaaaaatcaaagaactggagccatttgcaagtacattggttagaagtggaatagccgtaactttccattttatctcggcacttagggtttttaaaaatacagttaagttagatattcctgacttagcaaaagaatctccacagcagcttttcttttttttttttttaagtagacatgggatctcgctatattgcccaggctgtttttgaactcttggcctcaagcagtcctcctgcctaagcctcctaagtagctgggattacaggcataagtcactacacctggcttcttaaccttttctttatcacctccctgaagaacttttttagatttttttcttagtcaccccttccccatgatatttcaacaccagatatatactatgtatctgtttatggactgtaaatgttttttgctttatacaaaatagaatttttttttgtccccaatgaaccaattttcacccccattgagaatgcatgctcaagagcatccacgttttagataattgctgcctaaaatgttctatttgctattcatgttactgtgatccttttagaagggaaaatttattttttattttttttattttttattttttttatttttgagacaatctcactcttgcccaggctggagtgcagtggcgcaatctcggctcactgcaacctccgcctcccatgttcaagtgattcttctgcctcagcctcccgagtagctgggattacaggttcacaccaccatgcccggctaattttttgtatttttagtagagacggagtttcaccatgttggccaggctggtcttgaactcctgacctcaggtgatccacctgccttggcctcccaaagtgctgggattacaggcatgagccgcggagcctggcctagaaaggaaaatttaagtaagataccagcttcagaataggagctagggtctagagaaatggagcacattgtaactggctgacaacagtggcccaggaaaaccacagtaacttaatttgaaacttaatttgcttcccttgttttaatgactttttaatatttaaagatgttttctaaacctctaatcctcaaaacaaaaattggaagtaaactgattttcattcagtgaactgccatttagaagtgataggggtttacatactttgtaccattagttaacgcctaagctaaaagtataatatccagtttccctatgatctcaagtttatggaaagtagcctttcttttggcagtgtaaacaagcagttacattaaatacgtaaagataatgcattattctgctattttgtccttatcaagatcatgtagtaaaattttgtggtataagaggatagtgtttttccctaaggaagaggattttattggcattaaccaccaaagatggggttcctgagcctggaaaaccaagctgagaaggctgccattgactggaaaaggaggaaattcctcccttgaatgccctctttctggcctggattctgagaattccttgtgtgtttaaggacccttgtgggtggtagagaaactagttcctgtcacctgagcataaacagaagaacccctttgtactctacaccccagacataatgaactacttgcaatttcctaaacacatcattcacttgtcttttgcacattcttagactcttggaatacttcatttcctgccctctcgctttctccaatctcatgttctgctaatttttatttgtccttaaagtcttcgttttcttagggcagcacttcagtgaaatctttcataattcccttcccccagatactattttaggtgcctcctgttttttttctttctttctttctttctttcttttttctttttctttttttggtagcttaaacaataagacctttattgttacaaaacccagcagcgtgaggagttcctgggttgggtgaattagaggctggaaaaattcatcgcaagcattacaagataaccaatgatacccctgatgaaagaaaacctctgcaaactgctagctgaagccagctcctgtccttttatccaaaactgggtagtgtccagccaaaccattttgggggttgaatgagtcacttcaaagggctcaaatgactggtgaatcttccagataaaaggagagaacacagactttcctgcgcattttaaagtgactgaggtgctccacactctgatttatcctttattaccctgtggcagcattagcatacccctgctaccacatgcatcttgcaagcagtgatgtgtcatcaatatatgcaccgtggcaatcacagaatgctcaaatatttattgaataaaaagagcaagccatacctaattatagctaggtaagttgcatcttagtgttttatttgctttccccacccccatcccccattacgcctaagccctatctaaaagttgtatataactcatctgggtttagcaatgctatgaataaggaaaaacaaagaggaccaatctacgccgtggaagggaaatgcacttctctgatagagacagtgatcattacaggtcctcaagggaaaggtggaatatcaagggaaaagactgggaagctgtgaggtctttccacagtgatatttggcatttgcattttctaaaaatagctagcaagtattcttccatctttttctgttgcctaagagggtattataattcagataaaagatggctatggatgtacgaacaagatggataagaaaaatattcgagaattagaactgaccagatttgattgactgtagaagtgctgaaaatttctctttcttctgtttagctcatatatcttctccccagatactaagcataaagtgatagactaaattcctatctctgcatgtcaatatgttgacttttagtttgaagtagagccacacatatttggtcagaaattgattgtagagaataaaaaccctgtccaaccaggaaatgagcaaaagagggctggggtgaagattgcaagaatatacatctcagactccaggaaaaggaaaatacaggaactgtgaagactgttttcatttggagaccagcagccattccctctgtctctctattgctgctacccaattagcaacttcccctttgtgacttaaatgccaaaaagatgacattaatggctcaattcagtgtatgaaggattcctgagaagaatatatgataaagcatagcttcctaggtcacccttttaacagggaccaggagtttgggttgtggtagggctgtgtcctgaggtcaggccaagaagtgggctgatatgttaaaggacaactgaatacttcttcaactatataaagaccttctatatgtaatgccatgctatgtcattaatggcatttcattttagctttttaaaaaacccaacgaagggaaattcaaggtaatggaaacattttaagttttaaaatctgagtcctggtcatgggtctactacaaatgtgatttcttcccattgcttctgtttctctaggctaaaccaggaagatagttgtcaaaacttcgggtactattttaacatacatcagcacttgttaatttgctgtaattccctcaatagaacaccaagctttagttttcagtatgtttcttgggcaagtgaggtggtaggtggccatgtactagatcaaacttgattttctagggattgttttcccacttttagagaataccattcttaggctaaactcaattacagaatctactgcatgctatacagccctctatagaaatattcaccctgagtagttaattatgtttcttaatgggtaaatgttttatctagtccctctttttttttaatttgataaaatccagatctctcagagcttaaatacacttcctcttattttccctacaacaaatatggaaaagatctataatatatatttgaatatgtattaagttgttcctcacccttttctattttttattagctattgagtgtttattaatgcttcaaacacttccaagtgctttatgtatattaactgatttaattcttaagttactctatgagatggtattattatcccaacttaataggaaactgaagcacagtgagctaaagtaactctcgaagtggtggagcagagagatgaacccaggcagtctgactttagaacatctatgcttaccactatgatgttctcaaggaccccattctgaatataggaataaacaaattcagtttctcccactttaatctcacaacacccttctgactccagatgtgtgtggaggggggttccccacgcattaagcaaataagcaattttgcagcagacaccagctgggtgtcctctaattcaattcacttcttacactacctggagatagcatcagataccataggttgaaggctcagtgccacaagatggctcccacttcagatgacaatcagaagccccagatggtgaccaagggtcctaaccaactagctataagttagggttcccataaccccttcttgagctccattagtttgctagagaggctcacagaactcggaaacactatacagtcatgctgtacataatgacatttcaatgtcagcctgcatagacaatggtgatcccataagattataatactgtatttttactgtaccttttctatgtttaggtatgtttagatagacaaatagtcaatccttgaacaacttgggtttgaactgtgtgggtccatttatacatggattttttttcaataaatgtattggaaaattttttggagatttgcaacaatttgaaaaaccagatgaacctcatagactagaaatatcaaaaaaaataaaggtatgtgaagagtacataaaatac

SEQ ID NO: 191708 - DNA, 7905 bp, Homo sapiens
  Payload ID: 17873
  Gene Name: torsin A interacting protein 2
  Uniprot ID: Q8NFQ8
  ENST ID: ENST00000367612
  CDS Start-End: 389-1801
gggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaaggtaggaagagcagatgcacacttagggagcagctctgtggccctccctaaggaagcgagtgacggaactggagcatctcaggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaatttagcctttttaaaaacattttcccttccatgtatagtgcaatcaattgagggtgttgtcagttttctgtctgctatttcaaaagtcttttttttttttttttttttttgagatggagtctcactctgactcccaggctgcagtgctgtggcttgatcatagctcactgtagctttaaactcctgggctcaagcaatcctcccaccttagcctcctgagtagccgggactacaagtgcagactaccacaccactctaccacactattttgtatagagacagggtcttactgtgttgcctaggctggtcttgaactcctggcctcaagtgatcctcccacctcagcgtcccaaagtgtttggattacagatgtgacccaatgcacccaaccaaacttcttttttttttttttttttttttgagagaaggtcttgctctgtcacccaggctggaatgcagtgcagtggcacaatctcatctcactgtaacctacacctcctgggttcaagtgattcttgtgcctcagcctcccaagtagctgggattacaggcatgcaccacaatgcccagctaattattgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttttgagatggagtcttgctctgttgcccaggctggagtgcagtggtgcaatcttggctcactgcaagctccgcctcctgggttcatgccattctcctgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttctttattattattattattattattattatagtttaagttctgggatacatgtggagaacatgcaggtttgttaacataggtatacacgtgccatggtggtttgctgcacccatcaacccgtcatctacattaggtatttctcctaatgctatccctcccccagccccccaccccctgacaggccccagtgtgtgatgttccctgccctgtgtccaagtgttttctttgttcaattcccacctatgagtgagaacatgcgatgtttggtaaactgtgctataacttctgtatctctataggccaatccaaatggcctgagaacataatcagtatcccctaatctgcaaaaaggtaaataccttagtcttcagtacctttccttccagtattatctgcattatctgtgcccgcttgctgtgatgtcttgaaaagcccataaattggttcttattttggcaaatggtctcctgcttttcctcactgaggcttataaactaaatttgcctttggctaagcgcagttacatgaaccaaaaagaacattttagacttgggaagcaacaggctgagtcacattgtatggggcagagttggccaagcccccggcagtcacagccctactctctgtgttccttctaggcctgaggacgcatcaacacaaagctccaggcagttgctcctggttcatcagagagcacaggaaatttaaatctatttgcctttcctgtcataaaagaaacagcacactgactttcaaactcaattgcattttgcttatttgtgcttaacaaaaaatatgtgtgctttgccaatactaacgtcccacttctctgcactccctttctgtataacagggattgcttttgtatttgtttcttatagatgctgatgatgtgccttattcagattagttggccattaccagaataaagaataaatctgaatttttttca

SEQ ID NO: 191709 - DNA, 4364 bp, Homo sapiens
  Payload ID: 17873
  Gene Name: torsin A interacting protein 2
  Uniprot ID: Q8NFQ8
  ENST ID: ENST00000609928
  CDS Start-End: 812-2224
attcgggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctatcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaaggtaggaagagcagatgcacacttagggagcagctctgtggccctccctaaggaagcgagtgacggaactggagcatctcaggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaa

SEQ ID NO: 191710 - DNA, 888 bp, Homo sapiens
  Payload ID: 17873
  Gene Name: torsin A interacting protein 2
  ENST ID: ENST00000495650
  CDS Start-End: 777-888
cggccgctgggtgcagccgagcggtgtggagcggagagaatactcgaagggctctcctgatactaacagttttacgatttaaaacttcgccagaatttgtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccagg

SEQ ID NO: 191711 - DNA, 7067 bp, Homo sapiens
  Payload ID: 17873
  Gene Name: torsin A interacting protein 2
  Uniprot ID: Q9H496
  ENST ID: ENST00000482587
  CDS Start-End: 921-1316
gggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaaattgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgacaaagtagtcctagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgcgatcctctttttttttttttttttttttgctttttaaaaaatagtgacagagtcttgctgtatgacccaggctggtctccaactcctaggctcaagccatcctcccacctcggtctcccaaggtgctgggattacaggcgtgagccaccctacccggcctaggatccatgtttgctttttatcgttaggtttttttttctcaatgagtacaatatgacttcttgttgtaacagacattttaatccctaggaaaggctggaagtagagagcaaaaggctttctttcaagtcagtgttttatttgggaatcaagtctttcccaaaaatccctagcaaatttcttcttacatctcattagaaagtaccagtttacaagggagcctgggaaaccttggcaaaggggaatagggttagcattgcctgggtaggccacattgcctccattgaagaaatcagggcttttttttttttttttttttttttgagacagagtctcactctgtcgcccaggctggagtgcagtggcagtcttggttcactgcaacctctgccttccgggttcaagcaattctcctgcctcagcctcccgagtagctgggactacaggtgtgcgccaccacacttggctaatttttgtatttttagtagagatggggtttcaccattgttggccaggatggtcttgatctcttgatctcatgatccacccgccttggcctcccaaagtgctgggattacaggcatgagccactgtgcccagcccttttttttttttttttttgacggagtctcgctctcttgcccaggatggagtgtagtggcacgatctcggcttactgtaacctccacctcctaggttcaagcaattctcctgcctcagcctcctgagtagtggggattacaggtgcccgccaccatgtctggctaatttttgtgtttttagtagagacggggtttcaccatgttggccaggctggtcttgaactcctgacctcagatgatccacctgccctgacctccgacagtgctgggattacaggcatagccaccgtgcctgaccagggctcttttagcaaggaaaacgtgaggaatgaatggctgttggtgtgcaacaaatcatacttgctacatgttgtgaaacctgaagttatttgttagtctgtatgaagaatgtaccccagagatgcaccctgtatctgccttatgtctcttacaatggaggttctctcctgttatattgctgaataaactatgtgaactgctaaattgactgaagactagttagtttatcactaactctttaatgaagaatttcactatcctacaactcctcctaaaaagtgaaaatttactttgagagagtgctttcgagaatagtattatgatcagtattattgcccctaaattttttaattattagagaatgcttatgttacaaggacatatactaagaaacattctacaaatgtgaaaatttaaatatcagcaaaatagagaaaaggtttttgtttttgttttagtcaatatctccattaaatagtaagatcagattaaaaggatttatatcattgatttctcaaatcaatacctaagcagtacctgtgagagcttgtttaaaaatggagatttcttggtctgctttagaaattttgattcctcaggttgcttgtagggcccaggaatctgcatattataaataacacctcatgccgggtgccatggcatgtacctgttaccacagctacttcagaggttgaggcagcaggatcacttgagcccaggagttcaagaccagcctgggcaagatagtcagaccactgtctctttcaagaaaaaaaaacaacataaaagatataaatagtacctttggagattctgatgcaggtgctctctagaccatactttgagaaatgctgtagtaatatgtccatagtgtttacttatctggcttaaaaggatgggagcagaatactcatagtactgcaagatagtaccatttatttggtaatactggctatgtaaaaagagatttcatgtcagactgaagatcactgttaataatttaggtcataactcagccacatttttctcattaattaaactaatcaggaatgtttcagtcttcttcacaaacagttttgttcagtgtcattataaactatgtgaatatatgggcaagaaaaatgaatcaaaaatattaattttaatattaagagggttactttgccttcaaacatcacatacctgttatatgataagctgtcagaaatcaacatcatgtagtagagctcataaaattgagcaaaggagaaaattgaggaagcctttgaacaaagcttttcaccttaggtctttctagtatgtcttcatatggcttaaaatattgcaggttattctagaatactccatagttgatatgaataatgaattttattaaaatataaatgctgtgttggtaaaattaattgtaatgacaaatgatctggagggttatccagtgttttaaatagtgtgagctacactcgtctctatttttatagtgtggaagagttggtaatattgcttatatgttatggtagcatttctaaaatgaccattataactactccctgttattttatggcagtccagggagtgaaaaggttaatggaaacatgcaagggcagaccggaaagaaaatacatccaccaaagaggtggctgttgggggatatgagtgagtgaggtaagattcatctctgagttacaggtgaaggaagcccaggcaaacaggaaggcagaaatgagtccatggcatccaaagaatatgtggcagtccacatgtcatagctgtctgtaaaagtgagatgagccgcagcccgttcatctctccagtctccctggcaaccctgagtctccatggaattttggggacacagcttgaaaattgctttttatagaggcaaaataatggccttgcagccagctgggtttctattctaattctgatactattaaatgaccttaggcattttaacctctctgtatctagtttcttcatctgtgaaaaaggttgtgtaataatacctacctcatactgttgtgaggtttaagtgcaataacatataccaaacatatggcacatactaaatctttaggatgaggaaagatgtagggcaagaaagcaaaagcagaagttagaactggggaataaggtagagtcttacttgttttgttttgtttttttgagacagagtctcgttctgtcacctaggctggagtgcagtggcgccatcatggctcactgcagccttgaccttctgggctcaagtgatcctcccacttcagccccctaagtagctgtgactacaggcttgcaccaccatgcccagctaatttttttatttttgtagagatggagtatcgccatgttgcccaagctggtcttgagctcctggcctcaagcgatcctctcacctgggcctcccaaagtgctgggattataggcatgagccgccgtgtccaccgagtcttagttttagaactaagccaattgtttgaactgatggctgaattattataaacttattggctggtggctcactgtaattccagcactttgggaggctgaggcaggaggatggcttgagcccaggagttcaaaacaagcctgagcaacatagtgagacccccaactctacaaaaaagttttaaaaagaaaaaaattagctggatgtggtggtatgtgcctgtagtcccagctactcaggaggctgaggtgggaggatcacttgagcctcagtgagctatgagcttgaggctgcagtgagctatgatggtactactgccctccagcctgggcaacagagtaaggccctttatctaaaaacaaaaacaaaaaacttcttaaatctctcctgatgaaggacaggattggtttggggatgaggttgagcctgtagtataagtcagatggtcttgggtgtaaagattaaaaggcctggagggatggatgaccgaaggcagatttttgtcacaatgtttaggcccattttataatcttaattatggtagatataattgctgtatgacttttatcacctgagactttccacaacactgaaataaacaaattcctgaagtggtagttccctgaaaaggaaaaagaagaaatagagaaaagttgaaggatatgtacaaattcactcaggtcatatgtactggagtcacaattcaaacctagatgtaagttttccagagtcagggtgcttgtggtatgcttaatacaagcttttaaaagtgtcatggttaggtcccacagctagactacctgagttcaaatcctaactgccctcagtagtcacgtgttcttgggtaacgttcttaacttttctgtatctcagtttcctcatctctaaaatagtaggaatattaatagtctacacctcataagattgttgtgaagattaaacgagttaataaagtgctgtgaatgatgcctggcacaaagaaggcactcaataaatagtagttcttatagttgttgtatatgctttatttgttactcgttttcatagcaggattgtaactacttgtttcagggccaagataccagtttctttttatccctagagcctaaaatggcatcattcactaaaataaaattgtgtttaaaaataaagatatatacttaattcta

SEQ ID NO: 191712 - DNA, 2076 bp, Homo sapiens
  Payload ID: 17874
  Gene Name: torsin family 1, member A (torsin A)
  Uniprot ID: O14656
  ENST ID: ENST00000351698
  CDS Start-End: 50-1048
accggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgc

SEQ ID NO: 191713 - DNA, 2769 bp, Homo sapiens
  Payload ID: 17875
  Gene Name: torsin family 1, member B (torsin B)
  Uniprot ID: O14657
  ENST ID: ENST00000259339
  CDS Start-End: 61-1071
tcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccaccttt

SEQ ID NO: 191714 - DNA, 702 bp, Homo sapiens
  Payload ID: 17875
  Gene Name: torsin family 1, member B (torsin B)
  ENST ID: ENST00000427860
  CDS Start-End: 1-425
cccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctc

SEQ ID NO: 191715 - DNA, 1370 bp, Homo sapiens
  Payload ID: 17876
  Gene Name: torsin family 2, member A
  Uniprot ID: Q8N2E6
  ENST ID: ENST00000336067
  CDS Start-End: 23-751
aacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 191716 - DNA, 2477 bp, Homo sapiens
  Payload ID: 17876
  Gene Name: torsin family 2, member A
  Uniprot ID: Q5JU69
  ENST ID: ENST00000373281
  CDS Start-End: 25-786
acaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgggggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcaagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccag

SEQ ID NO: 191717 - DNA, 1523 bp, Homo sapiens
  Payload ID: 17876
  Gene Name: torsin family 2, member A
  Uniprot ID: Q5JU69
  ENST ID: ENST00000373284
  CDS Start-End: 48-1013
cgggcgaggcagttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcaagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccaga

SEQ ID NO: 191718 - DNA, 2211 bp, Homo sapiens
  Payload ID: 17876
  Gene Name: torsin family 2, member A
  Uniprot ID: Q5JU69
  ENST ID: ENST00000463577
  CDS Start-End: 25-243
acaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgggggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcaagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggaccag

SEQ ID NO: 191719 - DNA, 855 bp, Homo sapiens
  Payload ID: 17876
  Gene Name: torsin family 2, member A
  Uniprot ID: Q5JU69
  ENST ID: ENST00000493439
  CDS Start-End: 6-224
cccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcaagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcagcttcaccccacacccaggggccaggctctcccggggtctcatgctttgcccactgacccggcagttctgagcctggctttggcactcccagctttgtgactttgggtgagccttacagcccctgagtcctacacccagaaggcggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcc

SEQ ID NO: 191720 - DNA, 933 bp, Homo sapiens
  Payload ID: 17876
  Gene Name: torsin family 2, member A
  Uniprot ID: Q5JU69
  ENST ID: ENST00000496460
  CDS Start-End: 44-262
cgaggcagttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagcaacacgggtggcaagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttcccca

SEQ ID NO: 191721 - DNA, 831 bp, Homo sapiens
  Payload ID: 17876
  Gene Name: torsin family 2, member A
  Uniprot ID: Q5JU69
  ENST ID: ENST00000463256
  CDS Start-End: 6-224
cccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttc

SEQ ID NO: 191722 - DNA, 1182 bp, Homo sapiens
  Payload ID: 17877
  Gene Name: torsin family 3, member A
  Uniprot ID: Q9H497
  ENST ID: ENST00000352445
  CDS Start-End: 44-1054
ggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccataggtttttcatttctaacaaccagatggccccacctggacctgccaaccagttctgtggcccccacctaggaactgactcagcagaagagaacagcttcgattccccatgcttttactcaccaaattatccttaaaaactctgatccccaagttttctgagactgatttgagtaataataaaactccggtctcccgca

SEQ ID NO: 191723 - DNA, 519 bp, Homo sapiens
  Payload ID: 17877
  Gene Name: torsin family 3, member A
  ENST ID: ENST00000367625
  CDS Start-End: 60-519
gggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcaagaacttcgtggcacggatgctggtggagaacctgtatcgggacgggctgatgagtgactgtgtcaggatgttcatcgccacgt

SEQ ID NO: 191724 - DNA, 2724 bp, Homo sapiens
  Payload ID: 17877
  Gene Name: torsin family 3, member A
  Uniprot ID: Q9H497
  ENST ID: ENST00000367627
  CDS Start-End: 753-1946
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcaggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaa

SEQ ID NO: 191725 - DNA, 730 bp, Homo sapiens
  Payload ID: 17877
  Gene Name: torsin family 3, member A
  ENST ID: ENST00000447595
  CDS Start-End: 208-730
tgagattgcgccactgcactccagcctggtgacagagcaagactccatctcaaaaaaaaaaaaaaaaagaaagtagtccttgaatcccttctgctacaaagtctgccctctggcttcttattctaaggccaaacaggaggagtaactgattccacccgagagagattcagagttgcttggtttcttggctgttggctgttgtggtggatgggcctgtgtgtgccttttgctgtgactacctctttcctgtccttaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgagg

SEQ ID NO: 191726 - DNA, 1084 bp, Homo sapiens
  Payload ID: 17877
  Gene Name: torsin family 3, member A
  ENST ID: ENST00000483887
  CDS Start-End: 52-345
gggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctggctctagggaacgtccgctgtggacatgcctggtgactgccgtctcccttgctgcttttggacgcagggcttgaggaccgacagtgggccgagtcggggctgggagttagaatctgagttctgggtgtccctctgtccctgacaagttgtgtggcaaggttgccgcatcactgtagagcaccggatggtctcctctcggtctcacagctcctccttttccaggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtt

SEQ ID NO: 191727 - DNA, 4148 bp, Homo sapiens
  Payload ID: 17878
  Gene Name: torsin family 4, member A
  Uniprot ID: Q9NXH8
  ENST ID: ENST00000357503
  CDS Start-End: 197-1468
gacccacaggtgtcgctgcccctccaggccgaagctggcccaggaggcccctggcccaccccctcgccctgggaggcgcatttcctgcttggagtctcaggccccagcgtctggcacaggcaggggcctgcggagctgagggcagtggaccagctgcagggagggcgacctgtatgcggagcgccgttcctgcgacatggaccgcggccagcccagcctggagcctgctgccgcggccccccgagcctcgggccggtgcgtgatcgcgcccgtgcgcgctgtgctccgcctgcgccgccgggtgtgtgtcctacgcaaacggcgcctcctgcagccgggtggggggcccgacgtcgggaccggggcgcccaggccgggctgcagcccccgggcaccgcgcgcggacctggaccagccaaagttcttcaccttcgacagccccgcggagctaccctccaggacgccacgcaagaagcgccggcgcagccgcctggtgctttacccggagacctcgcgcaagtatcggccgcgcgtggagcacaggagccgcgcgcagcgctgccttctgctgctagtcgccatcgtgggcttccaagttctcaacgctatcgagaacctggacgataacgcgcagcgctatgacctcgacgggctggagaaagcgctgcagcgcgcggtgttcggccagcccgctgccgtatcgcgcatcgtggcgctgatgcgggactacctggccacgcatgtgcacagtcgtccgctcctcctggcgctgcacgggcccagtggcgtgggcaagagccacgtgggccgcctgctggcgcgccacttccgctcggtgctggaggacagcgcgctcgtgctgcaataccatgcgcggcaccactgccccgaggcgcgcgccgcacaggactgccgcgaggagctggcgcggcgcgtggccgacgtggtggcgcgggccgaagcggaggagaagaccccactcttggtgctggacgacgtggagctcatgccgcggccgctgctggacgagctgcacggcttcctgcagccgcagcgctcccaccacttccacaacgccatctacgtgctcctcagtggcgcgggtggcgccgaggtcacgcgcttcgtgctgcagaacgcgtcccgcgcgctgcccctgcgccccgacggcttccgcagtgccgaggccgcagcggcgcaggcggaagaagacctgcgcgccagcctgctggctgtgctgtcccgggagcatccgctgtggcaggccgcggccatcgtgccgtttctgctgctggacaagcgggatgtggtcagctgcttccgggacgagatggcgggtgagggcttctttcctgaccaggcccgcgcggagaacctggccgcgcagctcagcttctaccgcgtggctggccgcgagtttgccgtcaccggctgcaagcaggtggtggccacggtgaacctcctgtagtggaggcgcaggacgggacgtttgggttgatggcggcagtaggagggcgaccagggaccttgtgggctggtgcaggcccctgaggtttctagtgaatttgtggctgcccggctggtgggtgcggatcagcttggagctctgcttccaggtccacacccgcctcagagtccggagtctgtccctgggggcggcaggacagcagccacctccctcccaaacttgcccattgccctgctgggcgtcccaggcatggtctggtgcgttctccctgtggccccaagaggtgggttcccatggtacaaggatgatctcagggccaacaattcccggggtcacacagctgggacgtgaccccgcctcttgggggtggtcgcgtgttgctcagtgctgaagtggggttctcattccggcccccctggagatgaccccggaggaggccacagccaaccatgacagtgctggggctctggctgccttctccacccaccccacccctcactcaggtcgtgttttcaggagctcaaggctggagtgtcttgacagtaaggggaggggagcggaggcggaggcgcctcaggcagcctctccccctccttcctggaccccccaaccccgggcccgccagccctggcttgggcttactgggtgaccgagagcccgcggggcaagcgggaggtgcctaggcctctccccatccccctcttctccgcacgtgggacccttagcccgtggccagtcccctggtcaccacgattgcgcgacctccctttccctggggccttttgtgccccgagttccgcccacccgcaccctctgcgcagagcgccctccccacgccagtcgaccccacaccccacactccccacgcgccgcctcccggaagccctcctggacgcctcccgtggatgggcccaccgcgcccacgggggctttaggggaaggtgctttgggcgttttttgcgccatgtctcctcggggccggcggttgcctcgggacggttctcgcctcctcccacagccccggtgtctgggacgcacccggcagccccgctgctgccgccttgtggcgcgcccggcccagccggtggcttctgtggtcgccgggggctgagcgcgcggctgggccctgagtcccccaggccgccccgatcctctgtccccgccgccggccccgctgcagtcccaacccgggcctgcccgggaggagcgcaggggcggcgatgaccagtcccgaaaggggctcagagggcagcgaggaggtttcacgccggtgcggggcgccgtcgaggtgggggcaccgcgaaggtggaggcggggccgcgccggaagccccgagtcgagcgcacacggcgggcgcccctggcaagtgggactcctccggccccgaggcctgaactcagcccggagaccgcgcccaccagcgccggtgtccccggaggggccccgctagttccctgagcagaggtcctgcggcttcccggagggtgtcctgttctctcccccgcctcgcatccattctcgccctggtggttggtgtctgtggtcgggggcgagggccgtctagtggagacggggattcaggccgcttgaaagtctgggatctctgggcggatggcagcggctccgcggagctcgagctcggcgcgcaggtcctgggcccagggcgggagcgctagcgagagggctgccccgtcctgcccagagggtcctgaggactcccgctgctcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggtaatttttttgtattgttggtagagacggtgattcactatgttggccaggctagtcacgaactcctgacctcgtgatccgcccacctcggcctcccaaagtgctgggattacaggtgtgagccaccgtgcccggcctctttttatttattcctaaaatattaccttgaggccaaattctgcgcttaaggagaatgtgcaccaagtgctggggtgggggctggtaataaacgaggccacaaatcatgcttgttaataaattgtgtggttcaaatctga

SEQ ID NO: 191728 - DNA, 4321 bp, Homo sapiens
  Payload ID: 17879
  Gene Name: tousled-like kinase 1
  ENST ID: ENST00000359766
  CDS Start-End: 68-418
cgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagaaacaactggcaggcagctgaaaggactgtgcaagtgacgggactttatctgcagtaggttcccttgagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaagagataacagtatagcaacaactctgccactgaaatcctgttctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtggagaatgcagggcgttggctttaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaa

SEQ ID NO: 191729 - DNA, 5726 bp, Homo sapiens
  Payload ID: 17879
  Gene Name: tousled-like kinase 1
  Uniprot ID: Q9UKI8
  ENST ID: ENST00000360843
  CDS Start-End: 406-2769
gacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcaggggttccccaacctcccggtcttccagtccttggcctattgggaaatgggtcgtacagcaggaggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 191730 - DNA, 2783 bp, Homo sapiens
  Payload ID: 17879
  Gene Name: tousled-like kinase 1
  ENST ID: ENST00000409443
  CDS Start-End: 473-1714
aactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaagagataacagtatagcaacaactctgccactgaaatcctgttctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtggagaatgcagggcgttggctttaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttc

SEQ ID NO: 191731 - DNA, 539 bp, Homo sapiens
  Payload ID: 17879
  Gene Name: tousled-like kinase 1
  ENST ID: ENST00000453628
  CDS Start-End: 54-539
aaattatctgaaagtgttacttcccaacccccacccttcagcagttgttctaaatggctgttttattcttgtatgatttgaaaactactggcaagacaccggagaagaaacaatcggaatcatccaggggaagaaagagaaaagcagaaaaccagaatgaaagtagtcaggggttccccaacctcccggtcttccagtccttggcctattgggaaatgggtcgtacagcaggaggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggaggga

SEQ ID NO: 191732 - DNA, 2156 bp, Homo sapiens
  Payload ID: 17879
  Gene Name: tousled-like kinase 1
  Uniprot ID: Q9UKI8
  ENST ID: ENST00000434911
  CDS Start-End: 91-2103
attacaagcactttcaaaatgccaacatttccagaataaattatctgaaagtgttacttcccaacccccacccttcagcagttgttctaaatggctgttttattcttgtatgatttgaaaactactggcaagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacactt

SEQ ID NO: 191733 - DNA, 5663 bp, Homo sapiens
  Payload ID: 17879
  Gene Name: tousled-like kinase 1
  Uniprot ID: Q9UKI8
  ENST ID: ENST00000431350
  CDS Start-End: 406-2706
gacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 191734 - DNA, 2605 bp, Homo sapiens
  Payload ID: 17879
  Gene Name: tousled-like kinase 1
  Uniprot ID: Q9UKI8
  ENST ID: ENST00000521943
  CDS Start-End: 176-2332
aagagaagagagggagaaggcacactgaggaatgccaaggactgccagcagcaccagaagctaggagagaggcacagaacagactcctagcttctcctaggctccctctgagcctccaggaagaaccaatcccggtgacatcttgattttggacttctggcatcagaactgtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgtt

SEQ ID NO: 191735 - DNA, 3449 bp, Homo sapiens
  Payload ID: 17880
  Gene Name: tousled-like kinase 2
  Uniprot ID: Q86UE8
  ENST ID: ENST00000346027
  CDS Start-End: 272-2524
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 191736 - DNA, 3512 bp, Homo sapiens
  Payload ID: 17880
  Gene Name: tousled-like kinase 2
  Uniprot ID: Q86UE8
  ENST ID: ENST00000326270
  CDS Start-End: 269-2587
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgccctcttctgggaatacagagctaaaggatacagccccagccttaggagcccacagtttacttaggttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 191737 - DNA, 3227 bp, Homo sapiens
  Payload ID: 17880
  Gene Name: tousled-like kinase 2
  Uniprot ID: Q86UE8
  ENST ID: ENST00000343388
  CDS Start-End: 147-2303
ccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgc

SEQ ID NO: 191738 - DNA, 1784 bp, Homo sapiens
  Payload ID: 17880
  Gene Name: tousled-like kinase 2
  ENST ID: ENST00000581041
  CDS Start-End: 6-1784
cagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcatccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaag

SEQ ID NO: 191739 - DNA, 512 bp, Homo sapiens
  Payload ID: 17880
  Gene Name: tousled-like kinase 2
  ENST ID: ENST00000582195
  CDS Start-End: 246-512
aggagatactctgtgaggggccggcgtgttttctccatcttggcacttaccctcagaccctcctaagtacccgggagggccgtgtttttcatcggaggttgaaatggaacctccccctgggtgcccggggagagtaccttgggggcagcgcccctccttccggagggcagcatccccgcgggggcgggggctcggctttgatcccagggcaccttttgtccctggagacgctctgccagccagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgag

SEQ ID NO: 191740 - DNA, 530 bp, Homo sapiens
  Payload ID: 17880
  Gene Name: tousled-like kinase 2
  ENST ID: ENST00000578697
  CDS Start-End: 1-530
cagcaaaacagtccctcatctacgggatctggcaacacagagcattcctgcagctcccaaaaacagatctccatccagcacagacagacccaggccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaat

SEQ ID NO: 191741 - DNA, 3608 bp, Homo sapiens
  Payload ID: 17880
  Gene Name: tousled-like kinase 2
  ENST ID: ENST00000582809
  CDS Start-End: 704-2509
gttcagaatacagctgagcccagagattgcatggcaccaagagaggtttctgtcaagccgtcccgttccgagatgccccatcgcaccaacgaagcaactgctgagcagaaatgatggaagaattgcatagcctggacccacgacggcaggaattattggaggccaggtttactggagtaggtgttagtaaggaaaactagaaaagaggaggaaaaaacaataaatatgcaagaagaaataaatacattgcaaaacagaagaatgggaaataatcaagagttggaaaattaggaaacaaaaggcaaaatgaaggagagtacatcggatataacaaaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacat

SEQ ID NO: 191742 - DNA, 767 bp, Homo sapiens
  Payload ID: 17880
  Gene Name: tousled-like kinase 2
  ENST ID: ENST00000583843
  CDS Start-End: 646-767
aaggaagggaagcttctcggcctgacagttcagccaggtgcaggcactgtcatgttcatggccaccaggcatctgccaagcaccaggctctgtgctgcccactttacacagatggtctcatttggccttgatgacagcctgtggagaaatgatggaagaattgcatagcctggacccacgacggcaggaattattggaggccaggtttactggagtaggtgttagtaaggaaaactagaaaagaggaggaaaaaacaataaatatgcaagaagaaataaatacattgcaaaacagaagaatgggaaataatcaagagttggaaaattaggaaacaaaaggcaaaatgaaggagagtacatcggatataacaaaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaa

SEQ ID NO: 191743 - DNA, 496 bp, Homo sapiens
  Payload ID: 17880
  Gene Name: tousled-like kinase 2
  ENST ID: ENST00000583690
  CDS Start-End: 54-209
gcccctcccgggaggagcgtggagcggcggcggcggcggcggcagcagaaatgatggaagaattgcatagcctggacccacgacggcaggaattattggaggccaggtttactggagtaggtgttagtaaggaatgctgcaaggtctctgggagtcaaactattttgatggctattttgactctggtatggtatgaaaaggaaaactagaaaagaggaggaaaaaacaataaatatgcaagaagaaataaatacattgcaaaacagaagaatgggaaataatcaagagttggaaaattaggaaacaaaaggcaaaatgaaggagagtacatcggatataacaaaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggc

SEQ ID NO: 191744 - DNA, 550 bp, Homo sapiens
  Payload ID: 17880
  Gene Name: tousled-like kinase 2
  ENST ID: ENST00000580705
  CDS Start-End: 22-550
acgctctgccagccagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagac

SEQ ID NO: 191745 - DNA, 559 bp, Homo sapiens
  Payload ID: 17880
  Gene Name: tousled-like kinase 2
  ENST ID: ENST00000579450
  CDS Start-End: 342-559
aagcttctcggcctgacagttcagccaggtgcaggcactgtcatgttcatggccaccaggcatctgccaagcaccaggctctgtgctgcccactttacacagatggtctcatttggccttgatgacagcctgtggaggtctgtgttctgttaaaatatggaagaattaagagaagaacgaagaaataagggcagaaactccactggggagtacttgtctaaccctgaaaaagttcaaggctgttgttcaaggtctgaatttttcccttgagatttgcttgtagtccttaaagtcatcttcagacatctgatcaaggcagcatccgcggaaaattataagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactag

SEQ ID NO: 191746 - DNA, 1880 bp, Homo sapiens
  Payload ID: 17881
  Gene Name: TOX high mobility group box family member 2
  Uniprot ID: Q96NM4
  ENST ID: ENST00000341197
  CDS Start-End: 29-1549
agccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggc

SEQ ID NO: 191747 - DNA, 2605 bp, Homo sapiens
  Payload ID: 17881
  Gene Name: TOX high mobility group box family member 2
  Uniprot ID: Q96NM4
  ENST ID: ENST00000358131
  CDS Start-End: 209-1675
accaggagctccgaacacgcaggcccaaattggaataggagatggattttgataaaagaggttaaataacaggtttttccatttcaccttatacgaatgggatggggggtgggggtgctgggcctccagccaatagaggaccaagagttgtcaggagggcttataaagcttgctatttctggcattttttcctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 191748 - DNA, 2519 bp, Homo sapiens
  Payload ID: 17881
  Gene Name: TOX high mobility group box family member 2
  Uniprot ID: Q96NM4
  ENST ID: ENST00000372999
  CDS Start-End: 195-1589
cgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 191749 - DNA, 1709 bp, Homo sapiens
  Payload ID: 17881
  Gene Name: TOX high mobility group box family member 2
  Uniprot ID: Q96NM4
  ENST ID: ENST00000423191
  CDS Start-End: 87-1481
agcgcgcgtgggtttcccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgc

SEQ ID NO: 191750 - DNA, 1271 bp, Homo sapiens
  Payload ID: 17881
  Gene Name: TOX high mobility group box family member 2
  ENST ID: ENST00000413823
  CDS Start-End: 1-591
cgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 191751 - DNA, 3233 bp, Homo sapiens
  Payload ID: 17882
  Gene Name: TOX high mobility group box family member 3
  Uniprot ID: O15405
  ENST ID: ENST00000219746
  CDS Start-End: 286-2016
ccgcgcccccggcgcccggcccgcgcgcagcgctgcctcggtgccccggcggggcgcgtccccccggccgcctcccgctctcccgcggctcgcgtggccgcgcctttgtgtgcggcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatt

SEQ ID NO: 191752 - DNA, 3124 bp, Homo sapiens
  Payload ID: 17882
  Gene Name: TOX high mobility group box family member 3
  Uniprot ID: O15405
  ENST ID: ENST00000407228
  CDS Start-End: 189-1904
gaaccgacacgaggcttcacctgggaagcttcaagtctgcctacctgtgaaaggtcaggccccaacaccccttctgggaaatcctacagctaggatgcatttctctcactgaaccccatccagcagaggacagaagagtcagaagagggtagagaggatttagatactcatagaagatgtagtggaggatgaagtgccaacctcgctcgggagccaggcgcattgaggagagacttcattacctgataactacctatctgaaatttggaaataataataactatatgaatatggctgaggcgaacaatgcgttcttcgctgccagtgagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttca

SEQ ID NO: 191753 - DNA, 572 bp, Homo sapiens
  Payload ID: 17882
  Gene Name: TOX high mobility group box family member 3
  ENST ID: ENST00000563091
  CDS Start-End: 74-572
agcgctccgaggcagtggggacaaagaggaccggagcgggaaggggggcgagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctc

SEQ ID NO: 191754 - DNA, 548 bp, Homo sapiens
  Payload ID: 17882
  Gene Name: TOX high mobility group box family member 3
  ENST ID: ENST00000568436
  CDS Start-End: 118-300
cgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagcattttgcctgcaggctagaatctgtgttgttcattgcagtttgtgctcagccacggaaggcacctatccctagcacccaacccccatccacctagggctctataaaaagtttggaaataataataactatatgaatatggctgaggcgaacaatgcgttcttcgctgccagtgagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccct

SEQ ID NO: 191755 - DNA, 549 bp, Homo sapiens
  Payload ID: 17883
  Gene Name: TOX high mobility group box family member 4
  ENST ID: ENST00000455138
  CDS Start-End: 42-170
gagcgatgagggtctgagacggtgggagcggttgtgtgaagatggagtttcccggaggaaatgacaattacctgacgatcacagggccttcgcaccccttcctgtcaggggccgaggtgagccagagctgccgacgccgcggggacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggc

SEQ ID NO: 191756 - DNA, 2000 bp, Homo sapiens
  Payload ID: 17883
  Gene Name: TOX high mobility group box family member 4
  ENST ID: ENST00000455393
  CDS Start-End: 77-322
agtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagag

SEQ ID NO: 191757 - DNA, 633 bp, Homo sapiens
  Payload ID: 17883
  Gene Name: TOX high mobility group box family member 4
  ENST ID: ENST00000447695
  CDS Start-End: 56-187
agtgggggcggtgggagcgatgagggtctgagacggtgggagcggttgtgtgaagatggagtttcccggaggaaatgacaattacctgacgatcacagggccttcgcaccccttcctgtcaggggccgagcccctccttcaaaaaggcccaggaattgaacaaaggaggaaaggaaagctaagttagaagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtct

SEQ ID NO: 191758 - DNA, 4534 bp, Homo sapiens
  Payload ID: 17883
  Gene Name: TOX high mobility group box family member 4
  Uniprot ID: O94842
  ENST ID: ENST00000448790
  CDS Start-End: 104-1969
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgtgttttttgttttttttttttttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttac

SEQ ID NO: 191759 - DNA, 724 bp, Homo sapiens
  Payload ID: 17883
  Gene Name: TOX high mobility group box family member 4
  ENST ID: ENST00000416256
  CDS Start-End: 59-724
cacctgaaagagaaagcacactcccggaatcacgcagccctggaacaccttccagagtatggacttcccggaccagagaaggggggctcccgagccccgcccccggccgccccgaaccgccccgcccgtctcgaatcgcccagcccacaaatttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggagg

SEQ ID NO: 191760 - DNA, 565 bp, Homo sapiens
  Payload ID: 17883
  Gene Name: TOX high mobility group box family member 4
  ENST ID: ENST00000457430
  CDS Start-End: 56-565
agtgggggcggtgggagcgatgagggtctgagacggtgggagcggttgtgtgaagatggagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggagg

SEQ ID NO: 191761 - DNA, 4711 bp, Homo sapiens
  Payload ID: 17883
  Gene Name: TOX high mobility group box family member 4
  Uniprot ID: O94842
  ENST ID: ENST00000613569
  CDS Start-End: 277-2142
ccgcccccgccacccaatttgggagcttcgaatgcccgcccgagccttgaaggcgaaccacctgagggttacctgtgtctccgatgatgatatacttgaagagataagcataagtcatgggggcgatagcccagcgcctgactctctgcagccccacggcgctccttccaatcagcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgggggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgtgttttttgttttttttttttttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagccccttgaggactagcctgttctctggtcaccttaccagttgggttgcacattgtgtggtcgtccaaataactcaatcttgcgagtgccaggagatagtctttcaatcatgccatagatttcatctggtttatgactggtggaacgaacctaggaaataaaaactagctgctttttaagttacacaa

SEQ ID NO: 191762 - DNA, 2782 bp, Homo sapiens
  Payload ID: 17884
  Gene Name: TP53 induced glycolysis regulatory phosphatase
  Uniprot ID: Q9NQ88
  ENST ID: ENST00000179259
  CDS Start-End: 68-880
ggggaggtagcccgcagtgcaggggcagcgcggcgcggggccaccgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagcaaaataacactaacatgttttacgtataaatcaactattggaattttttattctagagggcttgaaatgtggatgaatacagattatgattgcagaatggtctgggggaagaagttaaaacatttgatttaaatacagtaaagaaagaatcttggagcagaagatagaagaacagccttttctaaataatgccttgccaaagtcaagtcaatggaaaccaggaaagccaaaaaaatgaagaatatccacttgcttcttatctaacctgtaggctgaagaatttccagtttgaggaaggctctaaagaaagtaaacagttaacagaacaccacacagtaatcagaataaaagaggggccttctttgtaaagaatggtgctctgggccgggcccagtggctcacacctgtaatcccagcactttgggaggctgaggcgggcggatcacaaggtcaggaattctagaccagcctggccaacaatggtgaaaccctgtctctactacaaatacaaaaaagccaggcgtggtagcaggcgcctgtaatcccagctacttgggaggttgaggcaggagaatcgcttgaacccgggaggtggaggttgcagtgagccgagatcgcaccacttcactccagcctaggtgacagaggggatgacagagggtgctctgcgggcagggaaggcggggtggttgggggggagagaatgttgctctgataaccacagctgtggttattttgtggcaggtacaggtgaggttgcctcttctttccaccagatggcactggagaaaagggattttgattaacttaattttatacacaagattggtctttcagaaatctttatctaaatgaagaaactgttctacatgtagttcgcttttaagtcaccatgttgctaaatgctgtgagtctcaactttaaagagggttaatactaaagttgtcagttaaggctatagtcacatatagtcaaaatttactttgacatcattttaaatcatatgtaaaattcagtattatattgttcttagtgtgtctagcactaccagttttctaccagtattgaaacagggcacgtgtttgagcatcagaggaagtatactgtaaataaaaatttgaaaaataagcaaaaaggacagacaataattatctccattcccaccatactgaagtcatctttccacttttttttttaaagaaacaaaacataaagataaaagtagagttctctttaaccagctctcacagtcctgttccctccagaggcagccactgcagtgagtctgtgtatatgttcacctgttcatctgcttgcaatgttcatctgttccttatattttcacctagtgtctggaaggagatggtactgttttggtgctttaaaaataaatatcaagccatctgtgttctttattttta

SEQ ID NO: 191763 - DNA, 3633 bp, Homo sapiens
  Payload ID: 17884
  Gene Name: TP53 induced glycolysis regulatory phosphatase
  ENST ID: ENST00000635110
  CDS Start-End: 1140-1775
aactgggcggcctgagaaagcaagaccagcgcccctgcctctgtctcattgtccccctgaagctttgagtttatgcttcaagctttgagtttactcattattatggtttctttcatgctgattcgctcggaggaccctggcccttctgctgcgctcaccgccgccgctctggtaaatgactgtccgcatggtttcaacatgcagttcttcctgcgaagtccactaggtggtactaatgccacggacaggatcactcacaaggaaacccagagccagccgggtgtaggttgcctctgccctgcacggaagggaacacctccctccagcagacagcactggagcagcacccccgcctccgccatctccccagggcagcctggggaaggaacgtcaggcctttcccgtccacacctggcgcagttccctcacctgcttctctcactaccgccacatcgtgactccatctggggtggctggtgctggttcatcaccttccctgactcttcagtgactaatccagagatggcacactggcagcttacagaccaaatccagcctgcagacataattagcttgactcccacagtgattgaaactgtcttggatttacttgccaatacaagatgagagctttcacataaaagtcaggattgtaacgactcttgggagatttaagtcctggcaaccacaggcccgcgaggccgcgagggctgcagctgagtgtgactggcccctttctctaccctctgcccaccccacaaccgactgaacccgctgctctcttttacggcgcctgccagtcggcttagggcttacagctctgcagcctaacctgtgtctgttttacctccctggccaggaaggagggcccagtaagtcccaagtggagtcatcctcctccaaccctctccaccacaaacagacctggaatacttctttcagtttgtggaccataacctctccttctcagacgaagaaagaccgtactgcctcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagcaaaataacactaacatgttttacgtataaatcaactattggaattttttattctagagggcttgaaatgtggatgaatacagattatgattgcagaatggtctgggggaagaagttaaaacatttgatttaaatacagtaaagaaagaatcttggagcagaagatagaagaacagccttttctaaataatgccttgccaaagtcaagtcaatggaaaccaggaaagccaaaaaaatgaagaatatccacttgcttcttatctaacctgtaggctgaagaatttccagtttgaggaaggctctaaagaaagtaaacagttaacagaacaccacacagtaatcagaataaaagaggggccttctttgtaaagaatggtgctctgggccgggcccagtggctcacacctgtaatcccagcactttgggaggctgaggcgggcggatcacaaggtcaggaattctagaccagcctggccaacaatggtgaaaccctgtctctactacaaatacaaaaaagccaggcgtggtagcaggcgcctgtaatcccagctacttgggaggttgaggcaggagaatcgcttgaacccgggaggtggaggttgcagtgagccgagatcgcaccacttcactccagcctaggtgacagaggggatgacagagggtgctctgcgggcagggaaggcggggtggttgggggggagagaatgttgctctgataaccacagctgtggttattttgtggcaggtacaggtgaggttgcctcttctttccaccagatggcactggagaaaagggattttgattaacttaattttatacacaagattggtctttcagaaatctttatctaaatgaagaaactgttctacatgtagttcgcttttaagtcaccatgttgctaaatgctgtgagtctcaactttaaagagggttaatactaaagttgtcagttaaggctatagtcacatatagtcaaaatttactttgacatcattttaaatcatatgtaaaattcagtattatattgttcttagtgtgtctagcactaccagttttctaccagtattgaaacagggcacgtgtttgagcatcagaggaagtatactgtaaataaaaatttgaaaaataagcaaaaaggacagacaataattatctccattcccaccatactgaagtcatctttccacttttttttttaaagaaacaaaacataaagataaaagtagagttctctttaaccagctctcacagtcctgttccctccagaggcagccactgcagtgagtctgtgtatatgttcacctgttcatctgcttgcaatgttcatctgttccttatattttcacctagtgtctggaaggagatggtactgttttgg

SEQ ID NO: 191764 - DNA, 1182 bp, Homo sapiens
  Payload ID: 17885
  Gene Name: TP53 regulated inhibitor of apoptosis 1
  Uniprot ID: O43715
  ENST ID: ENST00000546954
  CDS Start-End: 41-271
atcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcatta

SEQ ID NO: 191765 - DNA, 2012 bp, Homo sapiens
  Payload ID: 17886
  Gene Name: TP53 regulating kinase
  ENST ID: ENST00000372102
  CDS Start-End: 27-392
ggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggtaaggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctca

SEQ ID NO: 191766 - DNA, 3515 bp, Homo sapiens
  Payload ID: 17886
  Gene Name: TP53 regulating kinase
  Uniprot ID: Q96S44
  ENST ID: ENST00000372114
  CDS Start-End: 366-1127
gaaagagacgaccaactgagaggtgggcccccaaagccggctgcgagagtcaccgaagatttccggagagccaaggagtcgggaagagccacttactgagcgttgccgaacgtgtacggagatagccgaagaggcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaatta

SEQ ID NO: 191767 - DNA, 2031 bp, Homo sapiens
  Payload ID: 17887
  Gene Name: TP53 target 3
  Uniprot ID: Q9ULZ0
  ENST ID: ENST00000398682
  CDS Start-End: 636-1010
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctg

SEQ ID NO: 191768 - DNA, 1887 bp, Homo sapiens
  Payload ID: 17887
  Gene Name: TP53 target 3
  Uniprot ID: Q9ULZ0
  ENST ID: ENST00000565622
  CDS Start-End: 33-431
tggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttt

SEQ ID NO: 191769 - DNA, 1116 bp, Homo sapiens
  Payload ID: 17887
  Gene Name: TP53 target 3
  Uniprot ID: Q9ULZ0
  ENST ID: ENST00000569420
  CDS Start-End: 31-339
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaa

SEQ ID NO: 191770 - DNA, 1053 bp, Homo sapiens
  Payload ID: 17887
  Gene Name: TP53 target 3
  ENST ID: ENST00000563102
  CDS Start-End: 1-429
gggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaaggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttattt

SEQ ID NO: 191771 - DNA, 1181 bp, Homo sapiens
  Payload ID: 17888
  Gene Name: TP53 target 3 family member E
  ENST ID: ENST00000611321
  CDS Start-End: 31-339
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaatactttaatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagatta

SEQ ID NO: 191772 - DNA, 2026 bp, Homo sapiens
  Payload ID: 17888
  Gene Name: TP53 target 3 family member E
  ENST ID: ENST00000623491
  CDS Start-End: 636-1010
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctg

SEQ ID NO: 191773 - DNA, 1806 bp, Homo sapiens; identical to SEQ ID NO: 103612
  Payload ID: 17889
  Gene Name: TP53 target 3 family member F
  ENST ID: ENST00000617705
  CDS Start-End: 31-339

SEQ ID NO: 191774 - DNA, 2031 bp, Homo sapiens; identical to SEQ ID NO: 191767
  Payload ID: 17889
  Gene Name: TP53 target 3 family member F
  ENST ID: ENST00000623042
  CDS Start-End: 636-1010

SEQ ID NO: 191775 - DNA, 2034 bp, Homo sapiens
  Payload ID: 17890
  Gene Name: TP53 target 3B
  Uniprot ID: Q9ULZ0
  ENST ID: ENST00000341305
  CDS Start-End: 636-1010
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttt

SEQ ID NO: 191776 - DNA, 1116 bp, Homo sapiens; identical to SEQ ID NO: 191769
  Payload ID: 17890
  Gene Name: TP53 target 3B
  Uniprot ID: Q9ULZ0
  ENST ID: ENST00000569741
  CDS Start-End: 31-339

SEQ ID NO: 191777 - DNA, 1884 bp, Homo sapiens
  Payload ID: 17890
  Gene Name: TP53 target 3B
  Uniprot ID: Q9ULZ0
  ENST ID: ENST00000567724
  CDS Start-End: 33-431
tggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctg

SEQ ID NO: 191778 - DNA, 901 bp, Homo sapiens
  Payload ID: 17890
  Gene Name: TP53 target 3B
  ENST ID: ENST00000563564
  CDS Start-End: 1-22
cccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtgtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaa

SEQ ID NO: 191779 - DNA, 1116 bp, Homo sapiens; identical to SEQ ID NO: 191769
  Payload ID: 17891
  Gene Name: TP53 target 3C
  Uniprot ID: Q9ULZ0
  ENST ID: ENST00000360260
  CDS Start-End: 31-339

SEQ ID NO: 191780 - DNA, 1806 bp, Homo sapiens; identical to SEQ ID NO: 103612
  Payload ID: 17891
  Gene Name: TP53 target 3C
  Uniprot ID: Q9ULZ0
  ENST ID: ENST00000398667
  CDS Start-End: 31-339

SEQ ID NO: 191781 - DNA, 582 bp, Homo sapiens
  Payload ID: 17891
  Gene Name: TP53 target 3C
  Uniprot ID: Q9ULZ0
  ENST ID: ENST00000567137
  CDS Start-End: 11-319
atgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgat

SEQ ID NO: 191782 - DNA, 2029 bp, Homo sapiens
  Payload ID: 17891
  Gene Name: TP53 target 3C
  Uniprot ID: Q9ULZ0
  ENST ID: ENST00000561509
  CDS Start-End: 636-1010
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttt

SEQ ID NO: 191783 - DNA, 1879 bp, Homo sapiens
  Payload ID: 17891
  Gene Name: TP53 target 3C
  Uniprot ID: Q9ULZ0
  ENST ID: ENST00000569719
  CDS Start-End: 33-431
tggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctg

SEQ ID NO: 191784 - DNA, 1880 bp, Homo sapiens
  Payload ID: 17892
  Gene Name: TP53 target 3D
  Uniprot ID: Q9ULZ0
  ENST ID: ENST00000380148
  CDS Start-End: 33-431
tggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaattctctgcaccccaggagtgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctggaagctgctgtgggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtaaagaatggaacatttaagacaagtctggaaagtcatctgcctttaataactgtcgtttgtccttaacgtcagactttctccaagacaaaaactctaagaacttatttccattcttacaaatagtaaaaatgataaatcatatcaagtcaattgaaagtcctgcctgctgctttcctaaatcacaatatggccttggtatggttttatttgtacttttgtgggggattcgtggatctttagattaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 191785 - DNA, 2029 bp, Homo sapiens
  Payload ID: 17892
  Gene Name: TP53 target 3D
  Uniprot ID: Q9ULZ0
  ENST ID: ENST00000398664
  CDS Start-End: 636-1010
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtaaagaatggaacatttaagacaagtctggaaagtcatctgcctttaataactgtcgtttgtccttaacgtcagactttctccaagacaaaaactctaagaacttatttccattcttacaaatagtaaaaatgataaatcatatcaagtcaattgaaagtcctgcctgctgctttcctaaatcacaatatggccttggtatggttttatttgtacttttgtgggggattcgtggatctttagattaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctgttt

SEQ ID NO: 191786 - DNA, 1112 bp, Homo sapiens
  Payload ID: 17892
  Gene Name: TP53 target 3D
  ENST ID: ENST00000569631
  CDS Start-End: 31-339
gagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaattctctgcaccccaggagtgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctggaagctgctgtgggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaatagggctcccttggaaaataatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtaaagaatggaacatttaagacaagtctggaaagtcatctgcctttaataactgtcgtttgtccttaacgtcagactttctccaagacaaaaactctaagaacttatttccattcttacaaatagtaaaaatgataaatcatatcaagtcaattgaaagtcctgcctgctgctttcctaaa

SEQ ID NO: 191787 - DNA, 583 bp, Homo sapiens
  Payload ID: 17892
  Gene Name: TP53 target 3D
  ENST ID: ENST00000563025
  CDS Start-End: 11-319
atgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggctgtcacaaattctctgcaccccaggagtgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctggaagctgctgtgggagcctcatccaccgcttctctgaccccacccaggctgcttcccaggcctcagggtcttagtgtggacctccgggccgtgattaatgcagtttttcaggttaagtactgcacgactactcgcttctgaaactgat

SEQ ID NO: 191788 - DNA, 896 bp, Homo sapiens
  Payload ID: 17892
  Gene Name: TP53 target 3D
  ENST ID: ENST00000568044
  CDS Start-End: 1-22
cccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtgtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtaaagaatggaacatttaagacaagtctggaaagtcatctgcctttaataactgtcgtttgtccttaacgtcagactttctccaagacaaaaactctaagaacttatttccattcttacaaatagtaaaaatgataaatcatatcaagtcaattgaaagtcctgcctgctgctttcctaaatcacaatatggccttggtatggttttatttgtacttttgtgggggattcgtggatctttagattaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaa

SEQ ID NO: 191789 - DNA, 2374 bp, Homo sapiens
  Payload ID: 17893
  Gene Name: TP53 target 5
  Uniprot ID: Q9Y2B4
  ENST ID: ENST00000372726
  CDS Start-End: 158-1030
gctactgtcacatttcagtgatgtcacagctgcaggtggtacagagccagcaccaccatctgatgcccagcctgagtgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggtgttaaaaaacttgtcgctcttgaagctactcaagagctcaaaccgccggatccaagaactgcataagctggccaaaaggtgttggcattcactgctcagtgttccaaagattctccgcatctcctctggggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacctaagacgaatactgcttactctgcctgtttgtctggggctgggaaggatgaaggaaagaggccttcggtagagggagcctgtgtcgcgacttcaggcttcccccacccccaccccgaggcccctaaggtcagtctagaaccaaagaagccagcgagcagcacccctcccccacctccgcgagctagtctcctgagtggcgcgctctgtgaagtcagggcgctcgtgtgcttcctgggtgcaaagtgcctcacaatcgccccgcgagctcgcaagaggaaaccgcggcgcggaggcagcaagtaacttgcccaggctcactcagctagaaagtggcaggagcaagggctcctggttgctccccattccattttcccaagaaagggaaaaggcgaaatgagagcctgctcagaagtcacgaggcaggcggaatagccccagcaccctgtaggtcatgcgcgtgcattgcgacctgattgtcaaaaattgattgtcaaaaactgattgcactgtggctggtgtcaaaaagtggatgtcagctgggcctccaaatgtgtcctgccttggtcacagatcacagaaggcaccggatcaggagggggagctggtactgcatctctactgctccagggtgacatggcaggtccaccctcaatctgaagacctcaaccccaagccctggtcgaccccatctggccggggtcaccctctgtcggtaggagtcacagggtcctaaccatgccgttggggagaggaaagccaagggagcccgagttttctccggacgaagacctccatattccccagaggcaggctgcatggagtgggcgccctcgggagagcagtggagccatcgaggggcacagagctctccgggattgggggtcagggcagcgatgcagatagatctccagtttgggacagagggagaacgattggatggactctccccccctcccaccccgcccactcacacactcctccccaccattactgggcaccaagactgggcatcagctgccgcgcggaccagcctgggcggagccacagcgcggggactgcttagcacctcatagtggctgctgcgtgctcccgagctcctgctcccagcgcaatcttcctggagctcccctacggtcggtgcctacctccgcccccaccaccccgctaattcccgtgcaaattccaccccagtaaccactttcagcggtcttcccacccagcttgcactccagcccatttcctgaacagtctcccttgcagttcccttgctgggtattttcaatcccatcaactttcgaaaataatctctactcactcttccattc

SEQ ID NO: 191790 - DNA, 748 bp, Homo sapiens
  Payload ID: 17894
  Gene Name: TP53RK binding protein
  Uniprot ID: Q9Y3C4
  ENST ID: ENST00000272424
  CDS Start-End: 108-635
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtattgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtatt

SEQ ID NO: 191791 - DNA, 819 bp, Homo sapiens
  Payload ID: 17894
  Gene Name: TP53RK binding protein
  Uniprot ID: Q9Y3C4
  ENST ID: ENST00000318190
  CDS Start-End: 122-766
aaactggctcgaagaagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgtttcactcttgttgcccaggctggagtgcaatggcgcgatcttggctcacggcaacctctgcctcccgggttcaagcaattgtcctgcctcagcctcctgagttgctgggattacagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtattgggacattattggatgctatcatttgtagaatgtcaacaaaagatgttttatgaaatgtcagaaatattaacaaaaattctcagcattaaagaaaacattgattttc

SEQ ID NO: 191792 - DNA, 816 bp, Homo sapiens
  Payload ID: 17894
  Gene Name: TP53RK binding protein
  Uniprot ID: Q9Y3C4
  ENST ID: ENST00000409716
  CDS Start-End: 119-763
aaactggctcgaagaagacggggattggccatcgcttccggaagttgtgagctttgtttcggagcgggagctcttccgagacgcactgggggccggatgaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgtttcactcttgttgcccaggctggagtgcaatggcgcgatcttggctcacggcaacctctgcctcccgggttcaagcaattgtcctgcctcagcctcctgagttgctgggattacagattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtattgggacattattggatgctatcatttgtagaatgtcaacaaaagatgttttatgaaatgtcagaaatattaacaaaaattctcagcattaaagaaaacattgattttc

SEQ ID NO: 191793 - DNA, 3497 bp, Homo sapiens
  Payload ID: 17895
  Gene Name: TPX2, microtubule-associated
  Uniprot ID: Q9ULW0
  ENST ID: ENST00000300403
  CDS Start-End: 529-2772
tcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctga

SEQ ID NO: 191794 - DNA, 3605 bp, Homo sapiens
  Payload ID: 17895
  Gene Name: TPX2, microtubule-associated
  Uniprot ID: Q9ULW0
  ENST ID: ENST00000340513
  CDS Start-End: 529-2880
tcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaagacagggtcttgctccgtcacccaggctggagtgcagtggcgtgatcatggctcacttcagtgtccaactcctgggctcaagcaatcctcctgccttagccttccaaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctga

SEQ ID NO: 191795 - DNA, 2329 bp, Homo sapiens
  Payload ID: 17896
  Gene Name: TraB domain containing
  Uniprot ID: Q9H4I3
  ENST ID: ENST00000303434
  CDS Start-End: 120-1250
cgtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactc

SEQ ID NO: 191796 - DNA, 2272 bp, Homo sapiens
  Payload ID: 17896
  Gene Name: TraB domain containing
  Uniprot ID: Q9H4I3
  ENST ID: ENST00000380909
  CDS Start-End: 97-1227
cccgtccgttgagggcccgcgccgcatggaggccggctgaggagcgccgctgcctcgcctcggctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattcct

SEQ ID NO: 191797 - DNA, 2172 bp, Homo sapiens
  Payload ID: 17896
  Gene Name: TraB domain containing
  Uniprot ID: Q9H4I3
  ENST ID: ENST00000395827
  CDS Start-End: 86-1216
ccggtgtgcctcggcagccttgcgctgctctaatggtccggacttccgtgtgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggt

SEQ ID NO: 191798 - DNA, 1628 bp, Homo sapiens
  Payload ID: 17896
  Gene Name: TraB domain containing
  ENST ID: ENST00000395829
  CDS Start-End: 48-1187
tgcctctcctcaggctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaaagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaa

SEQ ID NO: 191799 - DNA, 1844 bp, Homo sapiens
  Payload ID: 17897
  Gene Name: TraB domain containing 2A
  Uniprot ID: Q86V40
  ENST ID: ENST00000335459
  CDS Start-End: 207-1577
ctccgctgccgcctaggcgcggggctgacctgcgggggtggggtggggggagggaggtcgaggcccggccccacgtggccgctgctgccgggctcaccccagccccgcccggaggcgccccgcggccccggctagccagggcgggcggccacctctgccctactccttccctccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaatacctttttttgtata

SEQ ID NO: 191800 - DNA, 1975 bp, Homo sapiens
  Payload ID: 17897
  Gene Name: TraB domain containing 2A
  Uniprot ID: Q86V40
  ENST ID: ENST00000409520
  CDS Start-End: 207-1724
ctccgctgccgcctaggcgcggggctgacctgcgggggtggggtggggggagggaggtcgaggcccggccccacgtggccgctgctgccgggctcaccccagccccgcccggaggcgccccgcggccccggctagccagggcgggcggccacctctgccctactccttccctccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctggtcatttcatgggcaacaacacagtgctggatgttttgcggcgtgaaggctatgaggtagaacacgcccctgctggacgacccatccacaaagggaagagtaaaaagacctccacacggcccactctgtccaccatctttgctccaaaagtccctaccctggaagtaccggcaccagaagccgtatcctcagggcactcaacgctgcctccccttgtgtcccggcctggaagtgccgacacgcccagtgaggccgaacagaggttccggaagaagcggaggcggtcacagcggaggccgcgactccggcaattcagcgatctgtgggtccgcctggaggagagtgacatagtcccgcaactccaggtccctgtcctggacaggcacatctccactgaactgcggctccctcgccgtgggcattcccaccacagccagatggtggccagcagtgcctgcctgtctctctggactcctgtgttctgggtgctggtgctggctttccaaacagagacacccctcctgtaacgactggaagcaccaggctaagaacctgacccctcggacttgaagaatggccattcctgtactccacattctggtctagccttgttgggcccaatccagaagagactgctcttgaaaaagcggcccagtgttgattcttctctttccaaggaatgtgactttgggttatccaactttgggggcaggtgtacagttttgtaacatagtgagttgtgtgaaaataaattataaatgagttgtatgaaaataaa

SEQ ID NO: 191801 - DNA, 1554 bp, Homo sapiens
  Payload ID: 17897
  Gene Name: TraB domain containing 2A
  ENST ID: ENST00000409133
  CDS Start-End: 112-1113
accccagccccgcccggaggcgccccgcggccccggctagccagggcgggcggccacctctgccctactccttccctccgcgttccgggcctcggagccgccttgaggaggatgagtccctggagctggttcctgctgcagaccctctgcctcctgcccacgggcgcagcttcgcggcgcggggcgcccggcaccgccaactgcgagctcaagccccaacaaagcgagctgaattccttcttgtggaccattaagcgagacccaccatcttacttctttggcacaatccatgtcccgtacacccgagtttgggacttcatccccgacaactctaaggaggctttcctgcagagcagcattgtgtactttgagttggatctcacagacccctataccatctcagctctcaccagctgtcagatgctgccacagggcgagaacctccaagatgtgctccccagggacatctactgccgcctcaagcgccacctggagtatgtcaagctcatgatgcccttgtggatgaccccagaccagcgcggcaaggggctctacgcagactacctcttcaatgctattgccggaaactgggagcgcaagaggcctgtctgggtgatgctcatggtcaactccctgactgaagtggacattaagtcccgtggagtgcctgtcttagacctgttccttgcccaggaggctgagcggctgaggaaacagactggggcagtggaaaaggtggaagagcagtgccatccattgaatgggttgaacttttcacaggtcatctttgctttgaaccagaccctcctgcagcaggaaagcctgcgagcaggcagtcttcagatcccctacacgacggaggatctcatcaaacactataactgcggggacctcagctccgtcatcctcagccatgacagctcccaggttcccaattttattaatgccacgctaccacctcaggagcgcatcactgctcaggagattgacagctacttacgccgggagctgatctacaagcggaatgagagaatagggaagcgggtgaaggcccttttggaggagttccctgacaaaggcttcttctttgcctttggagctgcttcacagtagccttgaaaatcaggagccttgaactacagtagctgtgaaaactgtttgcctaatggttactggaggggacagaatgggttcaaagttcctccaaagctccatccttaaagaatcatcactatttgacatgtccaatagttccctgaaatttccattcccaagcttgtcttcatttgacctgactcagagcttgctctgtgtgaatagccctattcttagggtgtgtgttgaaaacaatcagtagcagctgtttaacatcatagttgctggaaatagcaatattaattgaagcttacaaggggctgcccaaaaaacttaaaagcaaaatcccatagggggtatagaaaagctctaaaatattcctagagagtcacatgcatgagaagagctgtgcacatgcccaggaaagacctgagaaggtcctaatctctcacctctggc

SEQ ID NO: 191802 - DNA, 7034 bp, Homo sapiens
  Payload ID: 17898
  Gene Name: TraB domain containing 2B
  Uniprot ID: A6NFA1
  ENST ID: ENST00000606738
  CDS Start-End: 107-1660
tggagccccgtgctccagaggaaactccgtgcccaactgggggctccccgccccgctgaggggcgccgcccaggagggtcccccgcgccccgcgggccctggcaggatgcacgccgccctggcggggccgctgctcgccgccctcctcgccaccgctcgcgcccgcccgcagcccccggacggaggacagtgccggccgcccggatcgcagagggacttgaactccttcctgtggacgattcggcgtgatcctccggcctacctgtttggcactattcacgtcccctacacccgcgtctgggacttcatcccggacaactccaaggcagccttccaggctagcacccgtgtctactttgagctggaccttacagacccctacaccatctcggccctggccagctgccagctgctgccgcacggggaaaacctgcaggacgtgctgccccacgagctttactggcgcttgaagcgccacctggactacgtgaagttgatgatgccctcctggatgacgcccgctcagcggggcaaggggctctatgctgactacctattcaatgccatcgcgggcaactgggagcgcaagaggcccgtctgggtgatgctcatggtaaactcgctcacagagagggacgtgcgcttccgtggtgtgcccgtgctcgacctctacctggcccagcaggctgagaagatgaagaagaccacaggggctgtggagcaggtggaggagcagtgccatcccctcaacaacgggctcaacttctcccaggtgctgtttgccctgaaccaaaccctgctgcagcaggagagtgtgcgggccgggagcctgcaggcctcctacaccacggaggacctcatcaagcactacaactgcggagacctcagcgcagtcatcttcaaccacgacacatcccagctgcccaactttatcaacaccaccctcccgccacacgagcaggtgacggcccaggagattgacagctacttccgccaggagctcatctacaagaggaatgagcgcatggggaagagggtcatggcgcttctacgggagaacgaggacaagatctgcttctttgccttcggagcaggtcactttctggggaacaacacagtcatcgacatcctgcggcaggcagggctggaggtggaccacacacccgccgggcaggccatacacagccctgccccccagagcccagcgccctctcctgaggggacctcgacgagcccggccccagtgaccccagctgccgctgtccccgaagcaccctctgtgacccccaccgccccaccagaggatgaggatccagccctgtccccacacctcctgctccccgacagcctcagccagctggaggagtttggccggcagaggaagtggcacaagaggcagagcacacaccagcggccgcggcagttcaatgacctctgggtccgcatcgaggacagcaccaccgcctcaccacccccgctgcccctgcagcccacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctgacctcggccaccccaagtggagaagccagagaaatgacacaggggtcttcggccacacccaactgctcctgccaccacctccagggggtgcccaacacgtcgagggcagtccacatgggattggctagacactctagagctttactgtacccaagttacatcttcttttttgtagaaggatcttaatttcccatagtgctatggggctcttttgtaaaatacgtgtccatattaaaaaagaaaaatgtatttattctaccgataaaactattcttatgtggcctgtgttataaccccctagccctagtgctggcccgggaggggaacccgggacatcagtgacctcctgtggactgtggctctggactggcttgctcttggatcaccgaagcctcctgggtctgggtttggcttctccgactgtggggccctcagcaggaggggcaggcaggcaggcttagcctttgtgaagctggatttgggagccagaggtgtgaacgttggccatcctcccctctgctggatgcacccgcggcctgggaagataatttaggaaagagaatgctgctattgtgaaacccctgagtgtctatctggccctccagagctcttggtaagtgttttcaaccaaagcgctggggtggggtgggaggtgggatactggtgctgaggaaagcagtccccaccccacagaacaaatgaataaactgagatccagagagaaccaggtgggtagcccaaggtcacacggcaagtgggagagtgaggacataaatccagacctctctgttctggtgtcatgaatccagcttgggttaaaggagaggctgttgaagtcctggctaaatggattgagctgggccgagggactggagtgggcacaggagggcagttttagagacaggggcttaggcctcacatgatgttaatagtaatgagagctgccatttttccaaagcctgcagcgtggcaagcactttgcacacttgcttcactgattcttgcgctagttctgtgagatgtgactatccccatttcacagatgaggaaactgagccccccaaagaggcgaagggacttgctgaagatcccccagccaggatgtggccccagatcagtgtgatgcaaaacaattcctgcctcctgttccctgttctgccacgttctctctgcaagggagcagatctcacccaaactggggccagcacaagctttcactccaccaagaaaccttttggccggctgcttatgttgacccctctggccaaagggctctggcaactgcatgtgccatgtgtcgcatgtcctgacttgccagatcttggagcccacgagaagctttcctgccaaatcaaaggctgagaggtgggcacagctgtggggcacctggggaggcacagcagccaagtggggaggcaggtgacagggactccgagagactttagcccctcggctcctcaaggtggtggttgaggagacagaggacccaggtgggctaactcccacctgggaggcctgaaaccctatggggcaggtgcctcagtaattacagagtcctggaacctgacagcagaaaggacccttcacttgatggataatagtaacagtaggaggaataataaggcccacagagaggagacacttctccaaggctgcacagccgggtgggcctgctgactcccagcccagtgcaccccaactttatagcttcgtgggtttccctggcaggcttgatggcagctaattggccccagtgccatcttgcccagcttggcagctatctcccttctgagacggcaagttctgggcagctcatgggatggtcaggagtcccacgggcatcttggcaggcagctgaattctttacagctcagccctgatggacgtgtttgagcttgagacctggcaggagactggagctctgccttagagggcccagccagccctgtgggcaccatgctctaaactgaacttgacctcaatccaggctggagttggtttatccttggcaaaaatgtgacttcctatttctgagcgggaaggggcttagctgacttataaagcaggctcagaagttggacatcaaacggatcgtgcagtgcactatttggatgagataagtgtaaaggaattagaagcacacaggccagattcctctctgtttggggcagagtatggcgtgagacgtattgagatggagcttgaggttaattaaagatgaagcatttgggtaaacagtccaggcacctgaccgtgtgcccagatctgtgccaggcactgagccaagaaggtaaattaatgcagcttgtaattactgagcacatgcaatgccaggctctgtattagagctgaatctaaccactctccttggcccagaggaactcattatcaagatgggacaagcagtgcaatgctagattacgtcgtcctggcccctaacttcaggaagattcagccttagtctttcccagatccctcctctgggcatattaggggatcctaaactctcccttaccctaattcaagtgtttaaagaaagatggctagactaaccgatggagtagacatgtacctacaggagagcaagagccaatgtggtcagacatctgttgccaaagttcactgatctctgaggaccaccagctggccagggtctgaaatgaactcaacttgctgacttatgacccaaaagacttgaggcacatatgcaggaatctgcatgtctggggcacttgaattctctcatcctgggccagagaaccaccattccataagcagcaacccacacctttgacacgatctatccaccactaactgacatttcttccagaaacgttctttgtgcccagcctcataaaatgctcctgttgctctgagaaatttgtgtgcacttcttagacttttctgtttgactgtgaggcaggcaggaaagatgaaaggtctgagacccagcaggtaaagtgatctgcttaaggtcgggcagcatgttattgtggccctgggtcctctacctctcacgaaagctgactgtgtgatgaagggctctctggggcatgttggaatggccatgtccccaggtcttcctccagtggtgggtctgatgcaccagcagccagatgaagacagggagagccctgtcatccacagtggagggagaagaatcaggctgccagggagctgcaaagggctgctgaggatgcctccagtcctgagagtcaaagatctgggatctaggaagcatggaaccttgtgctggttatgaacaaatttgtccttgcattgaaagaccctaagcatattttcttcatgctaaataatgtgttatctacaacttcctggcctcggctagacctggacaagcctaggtgctcaggccccttgtcccacttgcctaatctccagcccagggccattgtcacagtggatcccaaagaggagggaaagtccttctaccaaaaggaaagtctattgaaaatgctgtgaaggacaagagaagttctccagggaattgcagctttgatggcatcctgtgtggcagacagcagaattggggctggtgatagtttttcagtgactgtgagataagaaccagagtcctcagcctcaccctgaagtgtccgctagacccttcgtgacccaaccctgctgaccagccacgtctctcatgtctcttaccctgtgcctggccagcgtgatgtgcagtcatctctagaatagacaggatgtttcacacatgctgctccctacccctggaaactcccttctctcccctgtaactgctcatccattgaggatcaacacagatagcacttcctccaggaagccccctcccattcctttgtgctttcttagcatctatcacaatacccactgcccagtgttgtgactatctagtgtgtatctgctcctctcggactgtgagcagcttaatggcaggggtcatgtaaatttgtttttgtaccctcatctgacacaaaggtggtgctcaacagatgtgtagagagagaaaggaagggaaggaagctgaaggaaggggaggaagaaaggaatgaaggcagaaaagaaggagagaggcagaccttagttccaccagtggcataatttccaccaagccaaagctgtctggggatggcccggagcccccaagggtggcaggtttcccatcgggagaggtgtttgagcaggggcagtgtgcccactggctgaagaagtggtaggagagttgacatcttgccaagggcctggtgtagatgacattgagggtccctcctggctctgcaatgatcaagttctatgaacattgttatttttccagaaattcatctgagcagccaaaaaaaatcaccccgctggctgtctaaaccagtaaggttcaggaataagtccagcctccccactccacccacaaccaccaccacccctcacagcgcccccttcaatgacccagctgggcttgactgctgcctttgggtgggggaacttctgaaaggtggaggaggagtgaactggaacccaggcctgcagcccagcccagagctccttcccgctctgccccactccctgaccccaggggaggaaagggttcacgagaactgattgaccccctacttggctctttccagggagcatcggctatcctcaccctttctccaagtgggagctgggctcttcctttccggagatactctggatactccttcactttgctggatgaccttgggcaagttcctgtccctctctgagccttcacttcctcatctgtcaaatgaagaccttgattcctgcctgggcagttctagggctggagggcaggggtgacatggacaatcttgggcctccatggagatgaggtgcttggctttcttcccaggacccacaggctgccatgggattgaaagcatgtggaggtgggaaaggtgacagagtagcatgcctccaaggcccccttcatcccagtcctgctgtggggaaagtgggctttgaacgggatccaagtctaagatgtttccggtgagctgccagggacaaagggctctcagacatcttgggtccccagtggctggggtgggcaggggctgattcagccaaaggaggctctagcccagaacagaggaagccagagcccctgccccattcttgagcctcacagagcttgtccccgagttgattcactgtgcaacacaggcttcagattcatgtatttgaaaggtattcatgatgttgttctcttatcacctctgcccctcacctctgtgaattatcatgaagagtcctttaagagtataaatagaagacaaagaaagatgctattaatgttattttgccaaaaatatttttgtagcataatatattaataaaagatattatgaattcaa

SEQ ID NO: 191803 - DNA, 1020 bp, Homo sapiens
  Payload ID: 17899
  Gene Name: trace amine associated receptor 1
  Uniprot ID: Q96RJ0
  ENST ID: ENST00000275216
  CDS Start-End: 1-1020
atgatgcccttttgccacaatataattaatatttcctgtgtgaaaaacaactggtcaaatgatgtccgtgcttccctgtacagtttaatggtgctcataattctgaccacactcgttggcaatctgatagttattgtttctatatcacacttcaaacaacttcataccccaacaaattggctcattcattccatggccactgtggactttcttctggggtgtctggtcatgccttacagtatggtgagatctgctgagcactgttggtattttggagaagtcttctgtaaaattcacacaagcaccgacattatgctgagctcagcctccattttccatttgtctttcatctccattgaccgctactatgctgtgtgtgatccactgagatataaagccaagatgaatatcttggttatttgtgtgatgatcttcattagttggagtgtccctgctgtttttgcatttggaatgatctttctggagctaaacttcaaaggcgctgaagagatatattacaaacatgttcactgcagaggaggttgctctgtcttctttagcaaaatatctggggtactgacctttatgacttctttttatatacctggatctattatgttatgtgtctattacagaatatatcttatcgctaaagaacaggcaagattaattagtgatgccaatcagaagctccaaattggattggaaatgaaaaatggaatttcacaaagcaaagaaaggaaagctgtgaagacattggggattgtgatgggagttttcctaatatgctggtgccctttctttatctgtacagtcatggacccttttcttcactacattattccacctactttgaatgatgtattgatttggtttggctacttgaactctacatttaatccaatggtttatgcatttttctatccttggtttagaaaagcactgaagatgatgctgtttggtaaaattttccaaaaagattcatccaggtgtaaattatttttggaattgagttcatag

SEQ ID NO: 191804 - DNA, 1157 bp, Homo sapiens
  Payload ID: 17900
  Gene Name: trace amine associated receptor 2
  Uniprot ID: Q9P1P5
  ENST ID: ENST00000275191
  CDS Start-End: 109-1029
tgacaaaattctatctgttcttgttttttgaaggaaaaattcaattgctctgaatatggaaatagatcttgcccagaaaatgaaagatctctgggtgtccgagtggctatgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggtggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttatggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtaggctttttctgcatgaataaattgaagcaaaaaactagaatttagaagaatgaagttgtttaagatgtgtgtttttgtgcatgtgtgtattattttagctaccatagaaagctgttggtttctaagacg

SEQ ID NO: 191805 - DNA, 1056 bp, Homo sapiens
  Payload ID: 17900
  Gene Name: trace amine associated receptor 2
  Uniprot ID: Q9P1P5
  ENST ID: ENST00000367931
  CDS Start-End: 1-1056
atggctgtctcatcagagcaacatgaactttcacatttcaaaagaacacagacaaaaaaggaaaaattcaattgctctgaatatggaaatagatcttgcccagaaaatgaaagatctctgggtgtccgagtggctatgtattcatttatggcaggatccatattcatcacaatatttggcaatcttgccatgataatttccatttcctacttcaagcagcttcacacaccaaccaacttcctcatcctctccatggccatcactgatttcctcctgggattcaccatcatgccatatagtatgatcagatcggtggagaactgctggtattttgggcttacattttgcaagatttattatagttttgacctgatgcttagcataacatccatttttcatctttgctcagtggccattgatagattttatgctatatgttacccattactttattccaccaaaataactattccagtcattaaaagattgctacttctatgttggtcggtccctggagcatttgccttcggggtggtcttctcagaggcctatgcagatggaatagagggctatgacatcttggttgcttgttccagttcctgcccagtgatgttcaacaagctatgggggaccaccttgtttatggcaggtttcttcactcctgggtctatgatggtggggatttatggcaaaatttttgcagtatccagaaaacatgctcatgccatcaataacttgcgagaaaatcaaaataatcaagtgaagaaagacaaaaaagctgccaaaactttaggaatagtgataggagttttcttattatgttggtttccttgtttcttcacaattttattggatccctttttgaacttctctactcctgtagttttgtttgatgccttgacatggtttggctattttaactccacatgtaatccgttaatatatggtttcttctatccctggtttcgcagagcactgaagtacattttgctaggtaaaattttcagctcatgtttccataatactattttgtgtatgcaaaaagaaagtgagtag

SEQ ID NO: 191806 - DNA, 1014 bp, Homo sapiens
  Payload ID: 17901
  Gene Name: trace amine associated receptor 5
  Uniprot ID: O14804
  ENST ID: ENST00000258034
  CDS Start-End: 1-1014
atgagagctgtcttcatccaaggtgctgaagagcaccctgcggcattctgctaccaggtgaatgggtcttgccccaggacagtacatactctgggcatccagttggtcatctacctggcctgtgcagcaggcatgctgattatcgtgctagggaatgtatttgtggcatttgctgtgtcctacttcaaagcgcttcacacgcccaccaacttcctgctgctctccctggccctggctgacatgtttctgggtctgctggtgctgcccctcagcaccattcgctcagtggagagctgctggttcttcggggacttcctctgccgcctgcacacctacctggacaccctcttctgcctcacctccatcttccatctctgtttcatttccattgaccgccactgtgccatctgtgaccccctgctctatccctccaagttcacagtgagggtggctctcaggtacatcctggcaggatggggggtgcccgcagcatacacttcgttattcctctacacagatgtggtagagacaaggctcagccagtggctggaagagatgccttgtgtgggcagttgccagctgctgctcaataaattttggggctggttaaacttccctttgttctttgtcccctgcctcattatgatcagcttgtatgtgaagatctttgtggttgctaccagacaggctcagcagattaccacattgagcaaaagcctggctggggctgccaagcatgagagaaaagctgccaagaccctgggcattgctgtgggcatatacctcttgtgctggctgcccttcaccatagacacgatggtcgacagcctccttcactttatcacacccccactggtctttgacatctttatctggtttgcttacttcaactcagcctgcaaccccatcatctatgtcttttcctaccagtggtttcggaaggcactgaaactcacactgagccagaaggtcttctcaccgcagacacgcactgttgatttgtaccaagaatga

SEQ ID NO: 191807 - DNA, 1038 bp, Homo sapiens
  Payload ID: 17902
  Gene Name: trace amine associated receptor 6
  Uniprot ID: Q96RI8
  ENST ID: ENST00000275198
  CDS Start-End: 1-1038
atgagcagcaattcatccctgctggtggctgtgcagctgtgctacgcgaacgtgaatgggtcctgtgtgaaaatccccttctcgccgggatcccgggtgattctgtacatagtgtttggctttggggctgtgctggctgtgtttggaaacctcctggtgatgatttcaatcctccatttcaagcagctgcactctccgaccaattttctcgttgcctctctggcctgcgctgatttcttggtgggtgtgactgtgatgcccttcagcatggtcaggacggtggagagctgctggtattttgggaggagtttttgtactttccacacctgctgtgatgtggcattttgttactcttctctctttcacttgtgcttcatctccatcgacaggtacattgcggttactgaccccctggtctatcctaccaagttcaccgtatctgtgtcaggaatttgcatcagcgtgtcctggatcctgcccctcatgtacagcggtgctgtgttctacacaggtgtctatgacgatgggctggaggaattatctgatgccctaaactgtataggaggttgtcagaccgttgtaaatcaaaactgggtgttgacagattttctatccttctttatacctacctttattatgataattctgtatggtaacatatttcttgtggctagacgacaggcgaaaaagatagaaaatactggtagcaagacagaatcatcctcagagagttacaaagccagagtggccaggagagagagaaaagcagctaaaaccctgggggtcacagtggtagcatttatgatttcatggttaccatatagcattgattcattaattgatgcctttatgggctttataacccctgcctgtatttatgagatttgctgttggtgtgcttattataactcagccatgaatcctttgatttatgctttattttacccatggtttaggaaagcaataaaagttattgtaactggtcaggttttaaagaacagttcagcaaccatgaatttgttttctgaacatatataa

SEQ ID NO: 191808 - DNA, 1029 bp, Homo sapiens
  Payload ID: 17903
  Gene Name: trace amine associated receptor 8
  Uniprot ID: Q969N4
  ENST ID: ENST00000275200
  CDS Start-End: 1-1029
atgaccagcaatttttcccaacctgttgtgcagctttgctatgaggatgtgaatggatcttgtattgaaactccctattctcctgggtcccgggtaattctgtacacggcgtttagctttgggtctttgctggctgtatttggaaatctcttagtaatgacttctgttcttcattttaagcagctgcactctccaaccaattttctcattgcctctctggcctgtgctgacttcttggtaggtgtgactgtgatgcttttcagcatggtcaggacggtggagagctgctggtattttggagccaaattttgtactcttcacagttgctgtgatgtggcattttgttactcttctgtcctccacttgtgcttcatctgcatcgacaggtacattgtggttactgatcccctggtctatgctaccaagttcaccgtgtctgtgtcgggaatttgcatcagcgtgtcctggattctgcctctcacgtacagcggtgctgtgttctacacaggtgtcaatgatgatgggctggaggaattagtaagtgctctcaactgcgtaggtggctgtcaaattattgtaagtcaaggctgggtgttgatagattttctgttattcttcatacctacccttgttatgataattctttacagtaagatttttcttatagctaaacaacaagctataaaaattgaaactactagtagcaaagtagaatcatcctcagagagttataaaatcagagtggccaagagagagaggaaagcagctaaaaccctgggggtcacggtactagcatttgttatttcatggttaccgtatacagttgatatattaattgatgcctttatgggcttcctgacccctgcctatatctatgaaatttgctgttggagtgcttattataactcagccatgaatcctttgatttatgctctattttatccttggtttaggaaagccataaaacttattttaagtggagatgttttaaaggctagttcatcaaccattagtttatttttagaataa

SEQ ID NO: 191809 - DNA, 1047 bp, Homo sapiens
  Payload ID: 17904
  Gene Name: trace amine associated receptor 9 (gene/pseudogene)
  Uniprot ID: Q96RI9
  ENST ID: ENST00000434551
  CDS Start-End: 1-1047
atggtgaacaatttctcccaagctgaggctgtggagctgtgttacaagaacgtgaacgaatcctgcattaaaactccttactcgccaggtcctcgatctatcctctacgccgtccttggttttggggctgtgctggcagcgtttggaaacttactggtcatgattgctatccttcacttcaaacaactgcacacacctacaaactttctgattgcgtcgctggcctgtgctgacttcttggtgggagtcactgtgatgcccttcagcacagtgaggtctgtggagagctgttggtactttggggacagttactgtaaattccatacatgttttgacacatccttctgttttgcttctttatttcatttatgctgtatctctgttgatagatacattgctgttactgatcctctgacctatccaaccaagtttactgtgtcagtttcagggatatgcattgttctttcctggttcttttctgtcacatacagcttttcgatcttttacacgggagccaacgaagaaggaattgaggaattagtagttgctctaacctgtgtaggaggctgccaggctccactgaatcaaaactgggtcctactttgttttcttctattctttatacccaatgtcgccatggtgtttatatacagtaagatatttttggtggccaagcatcaggctaggaagatagaaagtacagccagccaagctcagtcctcctcagagagttacaaggaaagagtagcaaaaagagagagaaaggctgccaaaaccttgggaattgctatggcagcatttcttgtctcttggctaccatacctcgttgatgcagtgattgatgcttatatgaattttataactcctccttatgtttatgagattttagtttggtgtgtttattataattcagctatgaaccccttgatttatgctttcttttaccaatggtttgggaaggcaataaaacttattgtaagcggcaaggtcttaaggactgattcgtcaacaactaatttattttctgaagaagtagagacagattaa

SEQ ID NO: 191810 - DNA, 2152 bp, Homo sapiens
  Payload ID: 17905
  Gene Name: TRAF family member-associated NFKB activator
  Uniprot ID: Q92844
  ENST ID: ENST00000259075
  CDS Start-End: 206-1483
tttctcagtggaagttcccacttcaacataagggagagctctggacagtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatca

SEQ ID NO: 191811 - DNA, 2171 bp, Homo sapiens
  Payload ID: 17905
  Gene Name: TRAF family member-associated NFKB activator
  Uniprot ID: Q92844
  ENST ID: ENST00000392749
  CDS Start-End: 240-1517
agaagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggta

SEQ ID NO: 191812 - DNA, 878 bp, Homo sapiens
  Payload ID: 17905
  Gene Name: TRAF family member-associated NFKB activator
  ENST ID: ENST00000402568
  CDS Start-End: 142-861
gtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgagatgcttttgacaagttataataagggagagatggtagtaaaggaagtgaagaagcgacgtgaaattgaaggaaaagaaaatgacctgccttcttaccgcggttggaatacacacccaaacgagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagcagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgcccatttggaagccctttcctaatcaagacagtgactcgg

SEQ ID NO: 191813 - DNA, 875 bp, Homo sapiens
  Payload ID: 17905
  Gene Name: TRAF family member-associated NFKB activator
  ENST ID: ENST00000406287
  CDS Start-End: 142-858
gtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgagatgcttttgacaagttataataagggagagatggtagtaaaggaagtgaagaagcgacgtgaaattgaaggaaaagaaaatgacctgccttcttaccgcggttggaatacacacccaaacgagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgcccatttggaagccctttcctaatcaagacagtgactcgg

SEQ ID NO: 191814 - DNA, 2155 bp, Homo sapiens
  Payload ID: 17905
  Gene Name: TRAF family member-associated NFKB activator
  ENST ID: ENST00000405852
  CDS Start-End: 98-1324
ggcgccggcgacctgaggggagagggaacgcagctgaaagcgtgaactacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagtctgtgcattcatgtttcagtagatggcaccctgcattgtacatttgctttctatactacagcaagggaaacagctgcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttgtatgtcctttgttcctgagtaaaaaaaaaa

SEQ ID NO: 191815 - DNA, 555 bp, Homo sapiens
  Payload ID: 17905
  Gene Name: TRAF family member-associated NFKB activator
  Uniprot ID: Q92844
  ENST ID: ENST00000403609
  CDS Start-End: 43-402
atttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtattt

SEQ ID NO: 191816 - DNA, 727 bp, Homo sapiens
  Payload ID: 17905
  Gene Name: TRAF family member-associated NFKB activator
  ENST ID: ENST00000439442
  CDS Start-End: 1-597
ttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagatggcaccctgcattgtacatttgctttctatactacagcaagggaaacagctgcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttt

SEQ ID NO: 191817 - DNA, 762 bp, Homo sapiens
  Payload ID: 17905
  Gene Name: TRAF family member-associated NFKB activator
  ENST ID: ENST00000457887
  CDS Start-End: 129-515
aatgcaacttccggttggagtcactcggccaggcgccggcgacctgaggggagagggaacgcagctgaaagcgtgaactacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaagctgtatccagtgcttgacttcactataacatcttttgtctcagtatatgtagactggtaaggaaatattcaacctcagttcctcctttaacatttcattcttagttctcaaaaatctaaaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactg

SEQ ID NO: 191818 - DNA, 564 bp, Homo sapiens
  Payload ID: 17905
  Gene Name: TRAF family member-associated NFKB activator
  ENST ID: ENST00000456358
  CDS Start-End: 69-564
atagcatcgtcggcctctgccccaacggcttcaagggagggactcgtcccggctgctttgcccgggaaatgggggtggaagggcctgcggtgtcgagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagaga

SEQ ID NO: 191819 - DNA, 600 bp, Homo sapiens
  Payload ID: 17905
  Gene Name: TRAF family member-associated NFKB activator
  ENST ID: ENST00000432002
  CDS Start-End: 187-600
acttcaacataagggagagctctggacagtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagcagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaat

SEQ ID NO: 191820 - DNA, 550 bp, Homo sapiens
  Payload ID: 17905
  Gene Name: TRAF family member-associated NFKB activator
  ENST ID: ENST00000440506
  CDS Start-End: 236-550
aagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaa

SEQ ID NO: 191821 - DNA, 533 bp, Homo sapiens
  Payload ID: 17905
  Gene Name: TRAF family member-associated NFKB activator
  ENST ID: ENST00000441987
  CDS Start-End: 109-219
actcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagtcactgcaataacatagcaaaattaatggattaacaatataagggaaactggcatttaagacaccaaaggtcaactatattctcttaatttcttaaaacttagtggagaagtttctgactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagc

SEQ ID NO: 191822 - DNA, 762 bp, Homo sapiens
  Payload ID: 17905
  Gene Name: TRAF family member-associated NFKB activator
  ENST ID: ENST00000429217
  CDS Start-End: 193-762
gttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagcagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaa

SEQ ID NO: 191823 - DNA, 1702 bp, Homo sapiens
  Payload ID: 17905
  Gene Name: TRAF family member-associated NFKB activator
  ENST ID: ENST00000437623
  CDS Start-End: 1-828
gtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcaagggaaacagctggtatgtgattacaacttgatggaaaagtattcagcttaaaaaattcaggagaattagtgttgagttgtcacaagacatggggcataagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaa

SEQ ID NO: 191824 - DNA, 576 bp, Homo sapiens
  Payload ID: 17905
  Gene Name: TRAF family member-associated NFKB activator
  ENST ID: ENST00000432692
  CDS Start-End: 109-486
actcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaagcctgagactcctcacttctgtcctcagctcttgcttctcatcttatcctgagccgtaagaagacaagaggtttcttctcctagaaaagaaacttcagcaaggagtcttggcagtcctttgctccatgaaaggggtaatata

SEQ ID NO: 191825 - DNA, 2028 bp, Homo sapiens
  Payload ID: 17906
  Gene Name: TRAF interacting protein
  Uniprot ID: Q9BWF2
  ENST ID: ENST00000331456
  CDS Start-End: 115-1524
aggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtggcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaacaatc

SEQ ID NO: 191826 - DNA, 820 bp, Homo sapiens
  Payload ID: 17906
  Gene Name: TRAF interacting protein
  ENST ID: ENST00000482582
  CDS Start-End: 22-820
ggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccag

SEQ ID NO: 191827 - DNA, 577 bp, Homo sapiens
  Payload ID: 17906
  Gene Name: TRAF interacting protein
  ENST ID: ENST00000482243
  CDS Start-End: 112-577
aagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggtgagagttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaag

SEQ ID NO: 191828 - DNA, 994 bp, Homo sapiens
  Payload ID: 17906
  Gene Name: TRAF interacting protein
  ENST ID: ENST00000473195
  CDS Start-End: 97-396
gccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctgctccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacagtgccttctctcttccaggccaagctggacaccttcctgtggtcgtgagaacagtgagtctga

SEQ ID NO: 191829 - DNA, 1145 bp, Homo sapiens
  Payload ID: 17906
  Gene Name: TRAF interacting protein
  ENST ID: ENST00000469027
  CDS Start-End: 122-976
ccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctgtatccttttcctgtgatgttgagctgagctgaactgtggagcccatactatgcctcacctatacccccagcctgccagtgccaacagcctcaggtgtgcagtgctgggcctcattctgtgtatcagcgccgcccacccccggctctgagcctttcttgccctgcattgcagtcctttctcgccctgcattgcagtcctttc

SEQ ID NO: 191830 - DNA, 4059 bp, Homo sapiens
  Payload ID: 17907
  Gene Name: TRAF2 and NCK interacting kinase
  Uniprot ID: Q9UKE5
  ENST ID: ENST00000284483
  CDS Start-End: 1-4059
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191831 - DNA, 4727 bp, Homo sapiens
  Payload ID: 17907
  Gene Name: TRAF2 and NCK interacting kinase
  Uniprot ID: Q9UKE5
  ENST ID: ENST00000341852
  CDS Start-End: 346-4176
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttg
